United States Patent 6,800,744 (NUCLEIC ACID AND AMINO ACID SEQUENCES RELATING TO STREPTOCOCCUS PNEUMONIAE FOR DIAGNOSTICS AND THERAPEUTICS) - sequence listing, part 2

SEQ ID NO: 2965 - protein, 312 aa, Streptococcus pneumoniae
  misc_feature (B) LOCATION 1...312
  hypothetical: YES
GRRTKMTELAKQLLELTYIVIGCQFLHTAYCSYKDKTNPVRLGTSAFWTLLSITFIGGSYMPNMSIGIIVILLSLLTLFKQVRIGTLPSLDEMKANIESNRLKNKIFIPVMLMAILALVLAQMIPEFSKISISLAALFATISVLVITNSHPKSLLSENNRMTQQVSTSGIVPQLLGALGAIFTVAGVGDVISHLISGIVPSDSRFIGVLAYVLGMVLFTMIMGNAFAAFTVITAGVGVPFVFALGANPIVAGALAMTAGYCGTLLTPMAANFNALPAALMDMKDQNGVIKAQAGVALVMIVIHIFLMYFLAF

SEQ ID NO: 2966 - protein, 348 aa, Streptococcus pneumoniae
  misc_feature (B) LOCATION 1...348
  hypothetical: YES
ILGTQEGKDMNITYIVGNGLDLQYGLKTRYRDFYEFQNKVYISRTENEEKYSNFIYESLFSDKVNDYENWSDFELSIGKLTKDNDLISSSIEIKEKFIDDFSEVVDDLREYLRIQQEKNLEKGNAIDFISTLDNMRTSLPVINQPAIDKKYNENLYQHDIVNILTLNYTNVIDKLYNESAKSFSNQLRTNNYKFHIAPPIHAHGTVDICTVLGVSDETQISNSFDEEQKESLIKNLVLKNYRENMDVKNSDIIKNSDIIILYGVSLGETDGYIWNQIAEQSIRSSVPVIIYHYVPHFDAGNPTRVKRLYRNVEDKFIQNSGIDLELEKKLRDNLIVVIGKTIFNLMER

SEQ ID NO: 2967 - protein, 260 aa, Streptococcus pneumoniae
  misc_feature (B) LOCATION 1...260
  hypothetical: YES
EGGTKLMALLEVKQLTKHFGGLTAVGDVTLELNEGELVGLIGPNGAGKTTLFNLLTGVYEPSEGTVTLDGHLLNGKSPYKIASLGLGRTFQNIRLFKDLTVLDNVLIAFGNHHKQHVFTSFLRLPAFYKSEKELKAKALELLKIFDLDGDAETLAKNLSYGQQRRLEIVRALATEPKILFLDEPAAGMNPQETAELTELIRRIKDEFKITIMLIEHDMNLVMEVTERIYVLEYGRLIAQGTPDEIKTNKRVIEAYLGGEA

SEQ ID NO: 2968 - protein, 263 aa, Streptococcus pneumoniae
  misc_feature (B) LOCATION 1...263
  hypothetical: YES
RGGTLMEISKGIIFNIQHFSIHDGPGIRTTVFLKGCPLRCPWCSNPESQRMKPEKMKDAQREKFTLVGEEKTVEEIITEVLKDKEFYEESGGGLTLSGGEIFAQFEFAKAILKSAKEHHIHTAIETTAFVDHEKFIDLIQYVDFIYTDLKHYNSIKHKKVTGVFNQMIIKNIHYAFSQNKTIVLRIPVIPNFNNSLEDAEKFATLFNSLNIDQVQLLPFHQFGENKYRLLNRKYEMDGINALHPEDLIDYQKVFLNHHINCYF

SEQ ID NO: 2969 - protein, 275 aa, Streptococcus pneumoniae
  misc_feature (B) LOCATION 1...275
  hypothetical: YES
AVETKLKRTYEEKLKILLLPKDPNDDKNIILEIRGAAGGDEAALFAGDLLTMYQKYAEAQGWRFEVMEASMNGVGGFKEVVAMVSGQSVYSKLKYESGAHRVQRVPVTESQGRVHTSTATVLVMPEVEEVEYDIDPKDLRVDIYHASGAGGQNVNKVATAVRIVHLPTNIKVEMQEERTQQKNREKAMKIIRARVADHFAQIAQDEQDAERKSTIGTGDRSERIRTYNFPQNRVTDHRIGLTLQKLDTILSGKLDEVVDALVLYDQTQKLEELNK

SEQ ID NO: 2970 - protein, 150 aa, Streptococcus pneumoniae
  misc_feature (B) LOCATION 1...150
  hypothetical: YES
RVLTTYLYDIESWTWFELYLFCNTMPFLSHQDLIFLSTSLLEKSKEFKELVHNRLYMKQGLLNILSELMERKLFSYIPIFEAELERMLRPYDVFEKVSWQFLKKMSVFLQTKGSNQKEIERFIQSLQVLENPQLTSLFELRFQQYKELID

SEQ ID NO: 2971 - protein, 247 aa, Streptococcus pneumoniae
  misc_feature (B) LOCATION 1...247
  hypothetical: YES
ISLTFFWEELGILLVKNLGALPMILGSFIVTILSALIATPFAIGAAVFMTEVSPKGAKILQPAIELLVGIPSVVYGFIGLQVVVPFVRSVFGGTGFGILSGISVLFVMILPTVTFMTTDSLRAVPRYYREASFAMGATRWQTIWRVILKAARSGIFTAVVFGMARAFGEALAIQMVVGNSAVIPTSLTTPAATLTSILTMGIGNTVMGTVNNNVLWSLALVLLLMSLVFNSVIKLITKERGKKNYAR

SEQ ID NO: 2972 - protein, 153 aa, Streptococcus pneumoniae
  misc_feature (B) LOCATION 1...153
  hypothetical: YES
INLTFLIELFTSYFNSLYFPLYSMKIKAQTRKLATGCSKHCFEVVDKTDEVSSKYCFEVADKTDEVSSKYCFEVADKTDEVSSKYCFEVADKTDEVSSKYCFEVADKTDEVSSKYCFEVADKTDEVSSKYCFEVADKTDEVSSKYCFEVADGS

SEQ ID NO: 2973 - protein, 85 aa, Streptococcus pneumoniae
  misc_feature (B) LOCATION 1...85
  hypothetical: YES
INLTFLIELFTSYFKSLYFKKVLAMTGTETFTVISTEDLEQTSGGLAVWEDGYSRWLYYREFAPYMRQGALNSYIDAWKYGFRTG

SEQ ID NO: 2974 - protein, 97 aa, Streptococcus pneumoniae
  misc_feature (B) LOCATION 1...97
  hypothetical: YES
GSLTARATTRAGTKVGLSDPVVPYGRAIAQRIKATLGITGLSPPRVHIDGEVWHLDVGSSHPGAVVGPKGWAVRPLKRHASWVQNVVRQFGPYPSRA

SEQ ID NO: 2975 - protein, 97 aa, Streptococcus pneumoniae; identical to SEQ ID NO: 2974
  misc_feature (B) LOCATION 1...97
  hypothetical: YES

SEQ ID NO: 2976 - protein, 97 aa, Streptococcus pneumoniae; identical to SEQ ID NO: 2974
  misc_feature (B) LOCATION 1...97
  hypothetical: YES

SEQ ID NO: 2977 - protein, 97 aa, Streptococcus pneumoniae; identical to SEQ ID NO: 2974
  misc_feature (B) LOCATION 1...97
  hypothetical: YES

SEQ ID NO: 2978 - protein, 78 aa, Streptococcus pneumoniae
  misc_feature (B) LOCATION 1...78
  hypothetical: YES
ASLTCSPSLDSIYICRARERPEDMRLLGVLVEVPNVYMRAAVSPTIRPIASITPAKIPGMATGRTILKTVRNLPAPSP

SEQ ID NO: 2979 - protein, 245 aa, Streptococcus pneumoniae
  misc_feature (B) LOCATION 1...245
  hypothetical: YES
KMLTNSIIKTKENSMLKWEDLPVEMKSSEVESYYQLVSKRKGSLIFKRCLDWVLALVLTWVLTSPIFLILSIWIKLDSKGPVIYKQERVTQYNRRFKIWKFRTMVTDADKKGSLVTSANDSRITKVGNFIRRVRLDELPQLVNVLKGEMSFVGTRPEVPRYTEQYSPEMMATLLLQAGITSPASINYKDEDTIISQMTEKGLSVDQAYVEHVLPEKMRYNLAYLREFSFFGDIKIMFQTVFEVLK

SEQ ID NO: 2980 - protein, 61 aa, Streptococcus pneumoniae
  misc_feature (B) LOCATION 1...61
  hypothetical: YES
MLLTSSVLSATSKQCFELTSSVLSTTSKQCFEQPVTSFLSDALVLIAYNQKEKFSPEKHIE

SEQ ID NO: 2981 - protein, 333 aa, Streptococcus pneumoniae
  misc_feature (B) LOCATION 1...333
  hypothetical: YES
NKLTRKNKGETMSQLYDITIVGGGPVGLFAAFYAHLRQAKVQIIDSLPQLGGQPAILYPEKEILDVPGFPNLTGEELTNRLIEQLNGFDTPIHLNETVLEIDKQEEEFAITTSKGSHLTKTVIIAMGGGAFKPRPLELEGVEGYENIHYHVSNIQQYAGKKVTILGGGDSAVDWALAFEKIAPTTLVHRRDNFRALEHSVQALQESSVTIKTPFAPSQLLGNGKTLDKLEITKVKSDETETIDLDHLFVNYGFKSSVGNLKNWGLDLNRHKIIVNSKQESSQAGIYAIGDCCYYDGKIDLIATGLGEAPTAVNNAINYIDPEQKVQPKHSTSL

SEQ ID NO: 2982 - protein, 89 aa, Streptococcus pneumoniae
  misc_feature (B) LOCATION 1...89
  hypothetical: YES
NELTPKVRQKKSNFWGVFIMKLTYDDKVQIYELRKQGYSLEKLSNKFGINNSNLRYMIKLIDRYGIEFGKKGKNRYYSPDLKQEMIYKV

SEQ ID NO: 2983 - protein, 97 aa, Streptococcus pneumoniae
  misc_feature (B) LOCATION 1...97
  hypothetical: YES
IELTKSAQSTALRLQMKLTKSAQNMFLRLWMKLTKSAQNMFLRLWMKLTKSAQNMFLRLWMKLTKSVTIHTVRRRDVVCRDFRRVLAFHIVFQSLSC

SEQ ID NO: 2984 - protein, 127 aa, Streptococcus pneumoniae
  misc_feature (B) LOCATION 1...127
  hypothetical: YES
IRLTKSAQNTVLRLQIRLTKSAQNTVLRLQIRLTKSAQNTVLRLQIRLTKSAQNTVLRLQIRLTKSAQNTVLRLQIRLTKSAQNTVLKLQIRLTKSAQNTVLRLQMEADVVCRDFRRVLYEKNPLLY

SEQ ID NO: 2985 - protein, 136 aa, Streptococcus pneumoniae
  misc_feature (B) LOCATION 1...136
  hypothetical: YES
FLMTKSLILVSHGRFCEELRGSTEMIMGLQDNIYTVALLPEDGPEEFTAKFEAVIEGLDDFLVFADLLGGTPCNVVSRLIMEGRDIDLYAGMNLPMVIEFINASLTGADADYKSRAAESIVKVNDLLAGFDDDEDE

SEQ ID NO: 2986 - protein, 151 aa, Streptococcus pneumoniae
  misc_feature (B) LOCATION 1...151
  hypothetical: YES
TNMTLTTFLLQAVASFLAIITFLIVLNVQRSMLLPGGILGMTVWLIYLLLKEPTNVIVATFIAAIIGSCVSQILSILYKTPAVVFILAILAPLVPGYLSYRTTAFFVTGDYNKALASGLLVVMLALVISIGMASGSVILRLYHYIKTHRVS

SEQ ID NO: 2987 - protein, 916 aa, Streptococcus pneumoniae
  misc_feature (B) LOCATION 1...916
  hypothetical: YES
KDMTERESVLHTMSRRRHMSKEQKRQAFYTQSPEEVLQAVDATEQGLSSSEAEKRLAEFGHNELEEGEKRSILVKFIEQFKDLMIIILVAAAILSVVTSGGEDIADAIIILAVVIINAAFGVYQEGKAEEAIEALKSMSSPVARVLRDGHMAEIDSKELVPGDIVALEAGDVVPADLRLLEANSLKIEEAALTGESVPVEKDLSVELATDAGIGDRVNMAFQNSNVTYGRGMGVVVNTGMYTEVGHIAGMLQDADETDTPLKQNLNNLSKVLTYAILVIALVTFVVGVFIQGKNPLGELLTSVALAVAAIPEGLPAIVTIVLSLGTQVLAKRHSIVRKLPAVETLGSTEIIASDKTGTLTMNKMTVEKVFYDAVLHDSADDIELGLEMPLLRSVVLANDTKIDVEGNLIGDPTETAFIQYALDKGYDVKGFLEKYPRVAELPFDSDRKLMSTVHPLPDGRFLVAVKGAPDQLLKRCLLRDKAGDIAPIDEKVTNLIHTNNSEMAHQALRVLAGAYKIIDSIPENLTSEELENDLIFTGLIGMIDPERPEAAEAVRVAKEAGIRPIMITGDHQDTAEAIAKRLGIIDANDTEDHVLTGAELNELSDEDFEKVVGQYSVYARVSPEHKVRIVKAWQKQGKVVAMTGDGVNDAPALKTADIGIGMGITGTEVSKGASDMILADDNFATIIVAVEEGRKVFSNIQKTIQYLLSANTAEVLTIFLSTLFGWDVLQPVHLLWINLVTDTFPAIALGVEPAEPGVMNHKPRGRKASFFSGGVLSSIIYQGVLQAALVMSVYGLAIAYPVHVGDNHAIHADALTMAFATLGLIQLFHAYNVKSVYQSILTVGPFKSKTFNWSILVSFILLMATIVVEPLEGIFHVTKLDLSQWGIVMAGSFSMIIIVEIVKFIQRKLGFDKNAI

SEQ ID NO: 2988 - protein, 234 aa, Streptococcus pneumoniae
  misc_feature (B) LOCATION 1...234
  hypothetical: YES
KCMTKRVLITGVSSGIGLAQARLFLEKGYQVYGVDQGEKPLLEGDFHFLQRDLTLDLEPIFDWCPQVDVLCNTAGVLDDYKPLLEQTAQDIQEIFEINYIIPVELTRYYLTQMLENKKGIIINMCSIASSLAGGGGHAYTSSKHALAGFTKQLALDYAEAGIQVFGIAPGAVKTAMTAADFEPGGLADWVASETPIKRWIEPEEIAELSLFLASGKASAMQGQILTIDGGWSLK

SEQ ID NO: 2989 - protein, 177 aa, Streptococcus pneumoniae
  misc_feature (B) LOCATION 1...177
  hypothetical: YES
EIMTETLIKIENLHKSFGKNEVLKGINLEIKRGEVVVIIGPSGSGKSTLLRSMNLLEEATKGKLIFEGVDITDKKNDLFAMREKMGMVFQQFNLFPNMTVMENITLSPIKTKGESREVAEKRAQELLEKVGLPDKADAYPQSLSGGQQQRIASRVGWLWYQMFCSLTNQLQPWILKW

SEQ ID NO: 2990 - protein, 496 aa, Streptococcus pneumoniae
  misc_feature (B) LOCATION 1...496
  hypothetical: YES
RVMTLVYQSTRDANNTVTASQAILQGLATDGGLFTPDTYPKVDLNFDKLKDASYQEVAKLVLSAFLDDFTVEELDYCINNAYDSKFDTPAIAPLVKLDGQYNLELFHGSTIAFKDMALSILPYFMTTAAKKHGLENKIVILTATSGDTGKAAMAGFANVPGTEIIVFYPKDGVSKIQELQMTTQTGDNTHVIAIDGNFDDAQTNVKHMFNDVALREKLTTNKLQFSSANSMNIGRLVPQIVYYVYAYAQLVKTGEIVAGEKVNFTVPTGNFGNILAAFYAKQIGLPVGKLICASNDNNVLTDFFKTRVYDKKREFKVTTSPSMDILVSSNLERLIFHLLGNNAEKTTELMNALNTQGQYKLTDFDAEILDLFAAEYATEEETAAEIKRVCELDSYIEDPHTAVASAVYKKYQSATGDVTKTVIASTASPYKFPVVAVEAVTGKAGLTDFEALAQLHEISGVAVPPAVDGLEIAPIRHKTTVAAADMQAAVEAYLGL

SEQ ID NO: 2991 - protein, 100 aa, Streptococcus pneumoniae
  misc_feature (B) LOCATION 1...100
  hypothetical: YES
LEMTTIRSLLLNFISISYSIFIQKIKKQTRKLVAGGSKHCFEIVDRTDKPCNIPAYIHTTRRYYPSLKRFSKSIHFCLLLIIPYSHKKTNILILKNAHFS

SEQ ID NO: 2992 - protein, 273 aa, Streptococcus pneumoniae
  misc_feature (B) LOCATION 1...273
  hypothetical: YES
KFVTSFYPIYAMVKEVSGDLNDVRMIQSSSGIHSFEPSANDIAAIYDADVFVYHSHTLESWAGSLDPNLKKSKVKVLEASEGMTLERVPGLEDVEAGDGVDEKTLYDPHTWLDPEKAGEDTQIIADKLSEVDSEHKETYQKNAQAFIKKAQELTKKFQPKFEKATQKTYVTQHTAFSYLAKRFGLNQLGIAGISPEQEPSPRQLTEIQEFVKTYKVKTIFTESNASSKVAETLVKSTGVGLKTLNPLEADPQNDKTYLENLEENMSVLAEELK

SEQ ID NO: 2993 - protein, 321 aa, Streptococcus pneumoniae
  misc_feature (B) LOCATION 1...321
  hypothetical: YES
LESTNKEKLVDDLLAFLAPITHPERLGKPNSQIEYTEDEVRIAQLADKYTTSDGYIFDEHDIISDEGDAYVTPHMGHSHWIGKDSLSDKEKVAAQAYTKEKGILPPSPDADVKANPTGDSAAAIYNRVKGEKRIPLVRLPYMVEHTVEVKNGNLIIPHKDHYHNIKFAWFDDHTYKAPNGYTLEDLFATIKYYVEHPDERPHSNDGWGNASEHVLGKKDHSEDPNKNFRADEEPVEETPAEPEVPQVETEKVEAQLKEAEVLLAKVTDSSLKANATETLAGLRNNLTLQIMDNNSIMAEAEKLLALLKGSNPSSVSKEKIN

SEQ ID NO: 2994 - protein, 248 aa, Streptococcus pneumoniae
  misc_feature (B) LOCATION 1...248
  hypothetical: YES
LQSTQVDAHGYMGRGWDWADMLGFTVAGYGVVSMDVRGQSGYSQDGLRSPLGNTVKGHIIRGAMEGRDHLFYKDVYLDIYQLVEIVASLSQVDEKRLSSYGASQGGALALVAAALNPRIQKTVAIYPFLSDFRRVIEIGNTSEAYDELFRYFKFHDPFHETEEEIMATLAYIDVKNLAHRIQGEVKMITGLDDDVCYPITQFAIYNRLTCDKTYRIMPEYAHEAMNVFVNDQVYNWLCGSEIPFKYLK

SEQ ID NO: 2995 - protein, 69 aa, Streptococcus pneumoniae
  misc_feature (B) LOCATION 1...69
  hypothetical: YES
KNTTSPFLVNTVSCLVVFCYFTVLSVYLYKKNLEGVTLQGFILLENLFKPRQLYLQPQNSVLSSLRLAS

SEQ ID NO: 2996 - protein, 521 aa, Streptococcus pneumoniae
  misc_feature (B) LOCATION 1...521
  hypothetical: YES
IATTWYIYLPPLNLTSWEFLFFLCGHLLVVAILFGFGKGINLVKTVHVRHGKAEAALNLEGFKINRLGKILLASIGGILLLAALVSLVTSSMFQAKNYANVVTVTEKDFTEFPRSDTSKVPILDRSTAEKIGDRYLGSLTDKVSQYVAADTYTQLTIDGKPYRVTPLEYADPIKWFNNQAKGIGEYIKVDMVTGNADLVDLKTPIKYSDSEYFNRDVKRHLRLKYPTKIFKTPSFEVDDEGNPFYVATVYQKQFGLAVPRPASVIILDATNGETKEYSLSDVPEWVDRIYPAEETIEQINYNGKYKDGFLNAMISKKNVTQTTKGYNYLSIGNDIYLYTGVTSANADESNLGFILENMRTGEITKYSLASATEESARESAEGAVQEKSYKATFPILINLNDKPLYIMGLKDNAGLVKEYALVDAVEYQNVIVATTVEEMLSKYANKNDLEIDNATTESINGVVADLKSAVIKGDTVYFFKVDGKIYKVKASVSDDYPYLENGKTFEGQVGKDNYLKTFKLR

SEQ ID NO: 2997 - protein, 337 aa, Streptococcus pneumoniae
  misc_feature (B) LOCATION 1...337
  hypothetical: YES
DMTTNRKDEHILYALEQKSSYNSFDEVELIHSSLPLYNLDEIDLSTEFAGRKWDFPFYINAMTGGSNKGREINQKLAQVAESCGILFVTGSYSAALKNPTDDSFSVKSSHPNLLLGTNIGLDKPVELGLQTVEEMNPVLLQVHVNVMQELLMPEGERKFRSWQSHLADYIKQIPVPIVLKEVGFGMDAKTIERAYEFGVRTVDLSGRGGTSFAYIENRRSGQRDYLNQWGQSTMQALLNAQEWKDKVELLVSGGVRNPLDMIKCLVFGAKAVGLSRTVLELVETYTVEEVIGIVQGWKADLRLIMCSLNCATIADLQKVDYLLYGKLKEAKDQMKKA

SEQ ID NO: 2998 - protein, 201 aa, Streptococcus pneumoniae
  misc_feature (B) LOCATION 1...201
  hypothetical: YES
AFATKPKQFIFMAKKELFTNRIFGWWIRMCGAFPIDRENPSASAIKYPINVLKKSDRSLIMFPSGSRHSNDVKGGAALIAKMAKVRIMPVTYTGPMTLKGLISRERVDMNFGNPIDISDIKKMNDEGIETVANRIQTEFQRLDEETKQWHNDKKPNPLWWFIRIPALILAIILAILTIIFSFIASFIWNPDKKREKLHRRE

SEQ ID NO: 2999 - protein, 265 aa, Streptococcus pneumoniae
  misc_feature (B) LOCATION 1...265
  hypothetical: YES
KTQTVTGVPKMSQEFLARILEQKAREVEQMKLEQIQPLRQTYRLAEFLKNHQDCLQVIAEVKKASPSLGDINLDVDIVQQAQTYEENGAVMISVLTDEVFFKGHLDYLREISSQVEIPTLNKDFIIDEKQIIRARNAGATVILLIVAALSEERLKELYDYATELGLEVLVETHNLAELEVAHRLGAEIIGVNNRNLTTFEVDLQTSVDLAPYFEEGRYYISESAIFTGQDAERLAPYFNGILVGTALMQAENVAQRIKELQIDKG

SEQ ID NO: 3000 - protein, 763 aa, Streptococcus pneumoniae
  misc_feature (B) LOCATION 1...763
  hypothetical: YES
RNKTIIRRQLNMLSLQEFVQNRYNKTIAECSNEELYLALLNYSKLASSQKPVNTGKKKVYYISAEFLIGKLLSNNLINLGLYDDVKKELAAAGKDLIEVEEVELEPSLGNGGLGRLAACFIDSIATLGLNGDGVGLNYHFGLFQQVLKNNQQETIPNAWLTEQNWLVRSSRSYQVPFADFTLTSTLYDIDVTGYETATKNRLRLFDLDSVDSSIIKDGINFDKTDIARNLTLFLYPDDSDRQGELLRIFQQYFMVSNGAQLIIDEAIEKGSNLHDLADYAVVQINDTHPSMVIPELIRLLTARGIDLDEAISIVRSMTAYTNHTILAEALEKWPLEFLQEVVPHLVPIIEELDRRVKAEYKDPAVQIIDESGRVHMAHMDIHYGYSVNGVAALHTEILKNSELKAFYDLYPEKFNNKTNGITFRRWLMHANPRLSHYLDEILGDGWHHEADELEKLLSYEDKAAVKEKLESIKAHNKRKLARHLKEHQGVEINPNSIFDIQIKRLHEYKRQQMNALYVIHKYLDIKAGNIPARPITIFFGGKAAPAYTIAQDIIHLILCMSEVIANDPAVAPHLQVVMVENYNVTAASFLIPACDISEQISLASKEASGTGNMKFMLNGALTLGTMDGANVEIAELVGDENIYIFGEDSETVIDLYAKAAYKSSEFYAREAIKPLVDFIVSDAVLAAGNKERLERLYNELINKDWFMTLLDLEDYIKVKEQMLADYEDRDAWLDKVIVNISKAGFFSSDRTIAQYNEDIWHLN

SEQ ID NO: 3001 - protein, 393 aa, Streptococcus pneumoniae
  misc_feature (B) LOCATION 1...393
  hypothetical: YES
KDKTKMGKYDFTSLPNRLGHHTYKWKETETDSEVLPAWIADMDFVVLPEIRQAVQTYADQLVYGYTYASEDLIKEVQKWEATQYGYNFDKEALVFIEGVVPAISTAIQTFTKEGEAVLINTPVYPPFARSVKLNNRRLITNSLVEKDGLFEIDFDQLEKDLVEEEVKLYILCNPHNPGGRVWEKEVLEKIGQLCQKHGVLLVSDEIHQDLTLFGHKHQSFNTINPAFKNFAIVLSSATKTFNIAGTKNSYAVIENPKLRLAFQKRLLANNQHEISGLGYLATEAAYRYGKDWLEELKQVFEDHINYVVDLFGKETKIKVMKPQGTYLIWLDFSAYDLTDETLQELLRNEAKVILNRGLDFGEEGSLHARINIAMPKSLLQEVCQRIVATFAKR

SEQ ID NO: 3002 - protein, 95 aa, Streptococcus pneumoniae
  misc_feature (B) LOCATION 1...95
  hypothetical: YES
NLKTDLYLVWVHLFREARKEARVIQLALDYHLEKIFVQAMQEFLGKYHGKSKGVSSYLHSFWSSAIVSVLLKWIKDGMKVPAEKIADLGLPFFKK

SEQ ID NO: 3003 - protein, 346 aa, Streptococcus pneumoniae
  misc_feature (B) LOCATION 1...346
  hypothetical: YES
LRKTSKMINQIYQLTKPKFINVKYQEEAIDQENHILIRPNYMAVCHADQRYYQGKRDPKILNKKLPMAMIHESCGIVISDPSGTYEVGQKVVMIPNQSPMQSDEEFYENYMTGTHFLSSGFDGFMREFVSLPKDRVVAYDAIEDTVAAITEFVSVGMHAMNRLLTLAHSKRERIPVIGDGSLAFVVANIINYTLPEAEIVVIGRHWEKLELFSFAKECYITDNIPEELAFDHAFECCGGDGTGPAINDLIRYIRPQGTILMMGVSEYKVNLNTRDALEKGLLLVGSSRSGRIDFENAIQMMKVKKFANRLKNILYLEEPVREIKDIHRVFATDLNTAFKTVFKWEV

SEQ ID NO: 3004 - protein, 371 aa, Streptococcus pneumoniae
  misc_feature (B) LOCATION 1...371
  hypothetical: YES
KVKTMKKVAIIGAGIVGATAAYYLSRESDLEVTVFDHEQGQATKAAAGIISPWFSKRRNKAWYKMARLGADFYVDLLADLEKSGQKIDFYQRSGVFLLKKDESKLEELYQLALQRREESPLIGQLAILDQASANELFPGLQGFDRLLYASGGARVDGQLLVTRLLEASHVKLVKEKVTLTLLSSGYQIGEEVFDQVILATGAWLGDMLEPLGYEVDVRPQKGQLRDYQLAQDMEAYPVVMPEGEWDLIPFAGGKLSLGATHENDMGFDLTVDEPLLQQMEEAALPHYPVLARATSRAERVGIRAYTSDFSPFFGQVPELAGVYAGSGLGSSGLTTGPIIGYHLAQLIQDKELTLDPLNYPIENYVKRVKSE

SEQ ID NO: 3005 - protein, 211 aa, Streptococcus pneumoniae
  misc_feature (B) LOCATION 1...211
  hypothetical: YES
RTKTSWFRLIIQKLKESKISDQSFSTSPLTQVINSPSLTSGATHFVEKLSDTEQLNKKVKIIPLEVVLRNYTAGSFSKRFGVDEGIALETPIVEFYYKNDDLDDPFINDEHVKFLQIAGDQQIAYLKEETRRINELLKVWFTEIGLKLIDFKLEFGFDKDGKIILADEFSPDNCRLWDADGNHMDKDVFRRGLGELTDVYEIVWEKLQELK

SEQ ID NO: 3006 - protein, 556 aa, Streptococcus pneumoniae
  misc_feature (B) LOCATION 1...556
  hypothetical: YES
GRKTASSLLSEKEKQMTLDKGKVVYQIYPKSYKDTTENGIGDFRGIIEKIPYLAKLGVDMVWLNPFYPSPQRDNGYDISDYMAVDPLFGDMADFEEMVCVGKEHKIDFMLDMVLNHCSTEHEWFQKALAGDKYYQDFFFIQDQPTDWQSKFGGSAWAPFGDTGKYYLHLFDETQADLNWRNPNVRKELFKVVNFWRDKGVKGFRFDVINLIGKDEVSVDCPENEGKPAYTDKPIVHNYLRMMNQATFGSDDSFMTVGEMSSTTMENCVLYSSPDRQELSMTFNFHHLKVDYKDGQKWTLAPFDFEELKSLYHSWGKEMSDKDGWSALFWNNHDQPRALNRFVDIQNFRKEGATMLAASIHLSRGTPYIYMGEEIGMIDPDYDSMADYVDVESLNAYQMLLEEGKSQQEAFQIIQAKSRDNSRIPMQWDASENAGFSTGTPWLKAGKSYKYINVENEIQGPIFTFYQDLIRLRKEMPIISEGSYKPAFEDSKQVYAFERQFEDQKLLVLNNFYAKEVEIDLPAVYQNGQILISNYEDAEVSEKILLKPYQTLAIYVN

SEQ ID NO: 3007 - protein, 96 aa, Streptococcus pneumoniae
  misc_feature (B) LOCATION 1...96
  hypothetical: YES
RNETLKMAVKIRLTRMGSKKKPFYRINVADSRSPRDGRFIETVGTYNPLVAENQVTLKEDRVLAWLANGAQPSDTVRNILSKEGVLKKFHDSKFSK

SEQ ID NO: 3008 - protein, 72 aa, Streptococcus pneumoniae
  misc_feature (B) LOCATION 1...72
  hypothetical: YES
QKETCMNTYCNINETMLSEVYGGNSGGAAVVAALGCAAGGVKYGRLLGPWGAAIGGIGGAVVCGYLAYTATS

SEQ ID NO: 3009 - protein, 284 aa, Streptococcus pneumoniae
  misc_feature (B) LOCATION 1...284
  hypothetical: YES
RKETAMQSTEKKPLTAFTVISTIILLLLTVLFIFPFYWILTGAFKSQPDTIVIPPQWFPKMPTMENFQQLMVQNPALQWMWNSVFISLVTMFLVCATSSLAGYVLAKKRFYGQRILFAIFIAAMALPKQVVLVPLVRIVNFMGIHDTLWAVILPLIGWPFGVFLMKQFSENIPTELLESAKIDGCGEIRTFWSVAFPIVKPGFAALAIFTFINTWNDYFMQLVMLTSRNNLTISLGVATMQAEMATNYGLIMAGAALAAVPIVTVFLVFQKSFTQGITMGAVKG

SEQ ID NO: 3010 - protein, 76 aa, Streptococcus pneumoniae
  misc_feature (B) LOCATION 1...76
  hypothetical: YES
SPWTTRLSKPLPSRPTVSIPMWMSNSTPSSETMPMACLVGKRTVTVPLTGEVNSPWLGSMTRPCPMTPDAKTGSVA

SEQ ID NO: 3011 - protein, 133 aa, Streptococcus pneumoniae
  misc_feature (B) LOCATION 1...133
  hypothetical: YES
QKWTKELMVTWILWALILAMLAWMGFNYLRIRRAAKIVDNEEFEALIRTGQLIDLRDPAEFHRKHILGARNIPSSQLKTSLAALRKDKPVLLYENQRAQRVTNAALYLKKQGFSEIYILSYGLDSWKGKVKTS

SEQ ID NO: 3012 - protein, 133 aa, Streptococcus pneumoniae
  misc_feature (B) LOCATION 1...133
  hypothetical: YES
MEWTTERRYRLYQEWTQEEIQHINENMAQSPWHTHXHVEAKTGLLNDPNGFSYFDGNWILFNQIFPFGAXHGLXSWAHLKINDWVHLXKPEIKFWQNPHXXFRVPTSVRPSNLGKNYSFFFRRFFPIKNGSSP

SEQ ID NO: 3013 - protein, 469 aa, Streptococcus pneumoniae
  misc_feature (B) LOCATION 1...469
  hypothetical: YES
SSRTSALFKGVEMKLTIHEIAQVVGAKNDISIFEDTQLEKAEFDSRLIGTGDLFVPLKGARDGHDFIKTAFENGAAVTLSEKEVSNHPYILVDDVLTAFQSLASYYLEKTTVDVFAVTGSNGKTTTKDMLAHLLSTRYKTYKTQGNYNNEIGLPYTVLHMPEGTEKLVLEMGQDHLGDIHLLSELARPKTAIVTLVGEAHLAFFKDRSEIAKGKMQIADGMASGSLLLAPADPIVEDYLPTDKKVVRFGQGAELEITDLVERKDSLTFKANFLEQALDLPVTGKYNATNAMIASYVALQEGVSEEQIHQAFQGLELTRNRTEWKKAANGADILSDVYNANPTAMKLILETFSAIPANEGGKKIAVLADMKELGDQSIQLHNQMILSLSPDVLDTVIFYGEDIAELAQLASQMFPIGHVYYFKKTEDQDQFEDLVKQVKESLSANDQILLKGSNSMNLAMLVESLENETK

SEQ ID NO: 3014 - protein, 101 aa, Streptococcus pneumoniae
  misc_feature (B) LOCATION 1...101
  hypothetical: YES
IRRTLSRTCLALTGASASTSPKRSRNLLFSKRRAVFSSTKLLRFFLMASTSAKVTNNCWEKSSSASNNSFVSIKQAPFLSLSFIFEFIFLSRPDIPWHFES

SEQ ID NO: 3015 - protein, 367 aa, Streptococcus pneumoniae
  misc_feature (B) LOCATION 1...367
  hypothetical: YES
HTGTHFKNSWFLNVPNMAKIGLGNIPRETPLKTVAAESNPTGYATKLEEVSLGKDTMTGHWEIMGLNITEPFDTFWNGFPEEILTKIEEFSGRKVIREANKPYSGTAVIDDFGPRQMETGELIIYTSADPVLQIAAHEDIIPLDELYRICEYARSITLERPALLGRIIARPYVGEPGNFTRTANRRDLAVSPFSPTVLDKLNEAGIDTYAVGKINDIFNGAGINHDMGHNKSNSHGIDTLLKTMGLAEFEKGFSFTNLVDFDALYGHRRNAHGYRDCLHEFDERLPEIIAAMRENDLLLITADHGNDPTYAGTDHTREYIPLLAYSPAFKGNGLIPVGHFADISATVADNFGVETAMIGESFLDKLV

SEQ ID NO: 3016 - protein, 288 aa, Streptococcus pneumoniae
  misc_feature (B) LOCATION 1...288
  hypothetical: YES
EFYFPRLARRLLVNDDYDVEVSFTIMNPPLLFSKRREVKKISWIHGSIEELLKDSSKRESHRSQLDAANTIVGISKKTSNSIKEVYPDYASKLQTIYNGYDFQTILEKSQEKIDIEIAPQSICTIGRIEENKGSDRVVEVIRLLHQEGKNYHLYFIGAGDMEEELKKRVKEYGIEDYVHFLGYQKNPYQYLSQTKVLLSMSKQEGFPGVYVEALSLGLPFISTDVGGAEELSQEGRFGQIIESNQEAAQAITNYMTSASNFDVDEASQFIQQFTITKQIEQVEKLLEE

SEQ ID NO: 3017 - protein, 102 aa, Streptococcus pneumoniae
  misc_feature (B) LOCATION 1...102
  hypothetical: YES
DKFAKLYAPFMKKDKEVYDKVCEYLSPHLNKDMEVLELACWFRVITVIEANSYVNIRSSRLLPKFKTQKINSWCAAYNIHFNNGYCKQHTNEFKDSLKSLIL

SEQ ID NO: 3018 - protein, 370 aa, Streptococcus pneumoniae
  misc_feature (B) LOCATION 1...370
  hypothetical: YES
GKFAKINKKKGALMANIFDYLKDVAYDSYYDLPLNELDILTLIEITYLSFDNLVSTLPQRLLDLAPQVPRDPTMLTSKNRLQLLDELAQHKRFKNCKLSHFINDIDPELQKQFAAMTYRVSLDTYLIVFRGTDDSIIGWKEDFHLTYMKEIPAQKHALRYLKNFFAHHPKQKVILAGHSKGGNLAIYAASQIEQSLQNQITAVYTFDAPGLHQELTQTAGYQRIMDRSKIFIPQGSIIGMMLEIPAHQIIVQSTALGGIAQHDTFSWQIEDKHFVQLDKTNSDSQQVDTTFKEWVATVPDEELQLYFDLFFGTILEAGISSINDLASLKALEYIHHLFVQAQSLTPEERETLGRLTQLLIDTRYQAWKNR

SEQ ID NO: 3019 - protein, 255 aa, Streptococcus pneumoniae
  misc_feature (B) LOCATION 1...255
  hypothetical: YES
MNIAKIVREAREQSRLTTLDFATGIFDEFIQLHGDRSFRDDGAVVGGIGWLGDQAVTVVGIQKGKSLQDNLKRNFGQPHPEGYRKALRLMKQAEKFGRPVVTFINTAGAYPGVGAEERGQGEAIARNLMEMSDLKVPIIAIIIGEGGSGGALALAVADRVWMLENSIYAILSPEGFASILWKDGTRAMEAAELMKITSHELLEMDVVDKVISEVGLSSKELIKSVKKELQTELARLSQKPLEELLEERYQRFRKY

SEQ ID NO: 3020 - protein, 203 aa, Streptococcus pneumoniae
  misc_feature (B) LOCATION 1...203
  hypothetical: YES
YDIAESHFYASANNVIRDDASSFHTFYFDPETGQPFKGVTRQGYSDDSCWARGQSWGVYGIPLTYRHLKDESCFDLFKGVTNFFLNRLPKDHVSYWDLIFNDGSDQSRDSSATAIAVCGIHEMLKHLPEVDADKDIYKHAMHAMLRSLIEHYANDQFTPGGTSLLHGVYSWHSGKGVDEGNIWGDYYYLEALIRFYKDWNLYW

SEQ ID NO: 3021 - protein, 61 aa, Streptococcus pneumoniae
  misc_feature (B) LOCATION 1...61
  hypothetical: YES
PAIASTTLPSFEYCSRYLAKFPSTPSSKFHKKNRNHASNNRMKLVVNVIVRNPRIKGAIDK

SEQ ID NO: 3022 - protein, 357 aa, Streptococcus pneumoniae
  misc_feature (B) LOCATION 1...357
  hypothetical: YES
KLIAAFYNMYKKRSVARSCLPRRAYSLYKTYPLISQYLSGTTASGLYEAKLAREEFPGEVHVFAPAFKDADLEELLEIMDHIVFNSERQLRKHGPRCREAGVSVGLRLNPQCSTQGDHALYDPCAPGSRFGVTIDKIPSDLLDLVDGLHFHTLCEQGADDLQTTLKAVEEQFGPYLHEVKWLNMGGGHHITREGYDVDLLISEIKRIRKTYNLEIYIEPGEAIALNAGYLATEVLDIVENGMEILVLDASATCHMPDVLEMPYRPSLRNGFEAQEKAHTYRLSSNTCLTGDVIGDYSFENPVQIGDRLYFQDMAIYSFVKNNTFNGIGLPSLYLMDEQGDCSLLKAFGYQDFKGRLS

SEQ ID NO: 3023 - protein, 290 aa, Streptococcus pneumoniae
  misc_feature (B) LOCATION 1...290
  hypothetical: YES
MRIADYSVTKAVLERHGFTFKKSFGQNFLTDTNILQKIVDTAEIDDQVNVIEIGPGIGALTEFLAERAAQVMAFEIDHRLVPILADTLRDFDNVTVVNEDILKVDLAQHIQNFKNPNLPIKVVANLPYYITTPILMHLIESGIPFSEFVVMMQKEVADRISAQPNTKAYGSLSIAVQYYMTAKVAFIVPRTVFVPAPNVDSAILKMVRRPEPAVAVEDENFFFKVSKASFTHRRKTLWNNLTGYFGKTEEVKDKLTKALDQADLSPSVRGEALSLAEFAGLADALKGQGL

SEQ ID NO: 3024 - protein, 283 aa, Streptococcus pneumoniae
  misc_feature (B) LOCATION 1...283
  hypothetical: YES
PMIAEFIDGLQKFHFLQNALITAIVVGIVAGAVGCFIILRGMSLMGDAISHAVLPGVALSFILGLDFFIGAIVFGLLAAIIITYIKGNSIIKSDTAIGITFSSFLALGIILNGVSKSSTELFHILFGYILAVQDTDMFITMGVGAAILLLIWIFFKQLLITSFDELLAKAMGMPVNFYHYLLMVLLTLVSVTAMQSVGTILIVAMLITPAATAYLYANSLKSMIFLSSTFGATASVLGLFIGYSFNVAAGSSIVLTAASFFLISFFIAPKQRYLKLKNKHLLK

SEQ ID NO: 3025 - protein, 154 aa, Streptococcus pneumoniae
  misc_feature (B) LOCATION 1...154
  hypothetical: YES
PMIAKEFETFLLGQEETFLTPAKNLAVLIDTHNADHATLLLSQMTYTRVPVVTDEKQFVGTIGLRDIMAYQMEHDLSQEIMADTDIVHMTKTDVAVVSPDFTITEVLHKLVDESFLPVVDTEGIFQGIITRKSILKAVNALLHDFSKEYEIRCQ

SEQ ID NO: 3026 - protein, 130 aa, Streptococcus pneumoniae
  misc_feature (B) LOCATION 1...130
  hypothetical: YES
NNVAIGVTFSGEASQMLEKNENLRYVVPTEASNLWCDNMVIPKTVKNQNSAYAFINFMLKPENALQNAEYVGYSTPNLPAKELLPEETKEDKAFYPDVETMKHLEVYEKFDHKWTGKYSDLFLQFKMYRK

SEQ ID NO: 3027 - protein, 73 aa, Streptococcus pneumoniae
  misc_feature (B) LOCATION 1...73
  hypothetical: YES
SQVAQNTVLRLWIELTKSAQNTVLRLQIELTKSVTSIRQGEADHGLKRFSKSIISSHSKSYQHKTHSIKVFIT

SEQ ID NO: 3028 - protein, 66 aa, Streptococcus pneumoniae
  misc_feature (B) LOCATION 1...66
  hypothetical: YES
PQVAQSTALRLQIELTKSAQNTVLRLQIELTKSVTYIAAKATLTRFEEIFEEYETKRRLVIVPASF

SEQ ID NO: 3029 - protein, 66 aa, Streptococcus pneumoniae
  misc_feature (B) LOCATION 1...66
  hypothetical: YES
LGVAPCEIGKSLSSREFSSAGRASALQAEGQRFDPVNSQRSRSVAVITSPCHGEDRGFDSRRDRLR

SEQ ID NO: 3030 - protein, 66 aa, Streptococcus pneumoniae; identical to SEQ ID NO: 3029
  misc_feature (B) LOCATION 1...66
  hypothetical: YES

SEQ ID NO: 3031 - protein, 82 aa, Streptococcus pneumoniae
  misc_feature (B) LOCATION 1...82
  hypothetical: YES
LGVAPCEIGKSLSSREFSSAGRASALQAEGQRFDPVNSHFSGCSLVVKLQPSKLLSRVRFSSPALNFVLCTKFLTWARSSGG

SEQ ID NO: 3032 - protein, 975 aa, Streptococcus pneumoniae
  misc_feature (B) LOCATION 1...975
  hypothetical: YES
MSYFRNRDIDIERISMNRSVQERKCRYSIRKLSVGAVSMIVGAVVFGTSPVLAQEGASEQPLANETQLSGESSTLTDTEKSQPSSETELSGNKQEQERKDKQEEKISRDYYARDLENVETVIEKEDVETNASNGQRVDLSSELDKLKKLENATVHMEFKPDAKAPAFYNLFSVSSATKKDEYFTMAVYNNTATLEGRGSDGKQFYGNYNDAPLKVKPGQWNSVTFTVEKPTPELPKGRVRLYVNGVLSRTSLKSGNFIKDMPDVTHVQIGATKRANNTVWGSNLQIRNLTVYNRALTPEEVQKRSQLFKRSDLEKKLPEGAVLTEKTDIFESGRNGKPNKDGIKSYRIPALLKTDKGTLIAGADERRLHSSDWGDIGMVIRRSEDNGKTWGDRVTITNLRDNPKASDPSIGSPVNIDMVLVQDPETKRIFSIYDMFPEGKGIFGMSSQKEEAYKKIDGKTYQILYREGEKGAYTIRENGTVYTPDGKATDYRVVVDPVKPAYSDKGDLYKGDQLLGNIYFTTNKTSPFRIAKDSYLWMSYSDDDGKTWSAPQDITPMVKADWMKFLGVGPGTGIVLRNGPHKGRILIPVYTTNNVSHLDGSQSSRVIYSDDHGKTWHAGEAVNDNRQVDGQKIHSSTMNNKRAQNTESTVVQLNNGDVKLFMRGLTGDLQVATSKDGGVTWEKDIKRYPQVKDVYVQMSAIHTMHEGKEYIILSNAGGPKRENGMVHLARVEENGELTWLKHNPIQKGEFAYNSLQELGNGEYGILYEHTEKGQNAYTLSFRKFNWEFLSKNLISPTEAKVKRTREMGKGVIGLEFDSEVLVNKAPTLQLANGKTATFLTQYDSKTLLFAVDKEDIGQEIIGIAKGSIESMHNLPVNLAGARVPGGVNGSKAAVHEVPEFTGGVNGTEPAVHEIAEYKGSDSLVTLTTKEDYTYKAPLAQQALPETGNKESDLLASLGLTAFFLGLFTLGKKREQ

SEQ ID NO: 3033 - protein, 655 aa, Streptococcus pneumoniae
  misc_feature (B) LOCATION 1...655
  hypothetical: YES
RLSATAGLVLLAAGVLAACSSSKSSDSSAPKAYGYVYTADPETLDYLISSKNSTTVVTSNGIDGLFTNDNYGNLAPAVAEDWEVSKDGLTYTYKIRKGVKWFTSDGEEYAEVTAKDFVNGLKHAADKKSEAMYLAENSVKGLADYLSGTSTDFSTVGVKAVDDYTLQYTLNQPEPFWNSKLTYSIFWPLNEEFETSKGSDFAKPTDPTSLLYNGPFLLKGLTAKSSVEFVKNEQYWDKENVHLDTINLAYYDGSDQESLERNFTSGAYSYARLYPTSSNYSKVAEEYKDNIYYTQSGSGIAGLGVNIDRQSYNYTSKTTDSEKVATKKALLNKDFRQALNFALDRSAYSAQINGKDGAALAVRNLFVKPDFVSAGEKTFGDLVAAQLPAYGDEWKGVNLADGQDGLFNADKAKAEFAKAKKALEADGVQFPIHLDVPVDQASKNYISRIQSFKQSVETVLGVENVVVDIQQMTSDEFLNITYYAANASSEDWDVSGGVSWGPDYQDPSTYLDILKTTSSETTKTYLGFDNPNSPSVVQVGLKEYDKLVDEAARETSDLNVRYEKYAAAQAWLTDSSLFIPAMASSGAAPVLSRIVPFTGASAQTGSKGSDVYFKYLKLQDKVVTKEEYEKAREKWLKEKAESNEKAQKELASHVK

SEQ ID NO: 3034 - protein, 268 aa, Streptococcus pneumoniae
  misc_feature (B) LOCATION 1...268
  hypothetical: YES
MTYLPVALTIAGTDPSGGAGIMADLKSFQARDVYGMAVVTSLVAQNTRGVQLIEHVSPQMLKAQLESVFSDIPPQAVKTGMLATTEIMEIIQPYLKKLDCPYVLDPVMVATSGDALIDSNARDYLKTNLLPLATIITPNLPEAEEIVGFSIHDPEDMQRAGRLILKEFGPQSVVIKGGHLKGGHLKGGAKDFLFTKNEQFVWESPRIQTCHTHGTGCTFAAVITAELAKGKSLYQAVDKAKAFITKAIQDAPQLGHGSGPVNHTTFKD

SEQ ID NO: 3035 - protein, 308 aa, Streptococcus pneumoniae
  misc_feature (B) LOCATION 1...308
  hypothetical: YES
RRPATGHGHAGPAPPRRRAGAVAPAGAPHGFRLRWRPGCAPARHLAGARDRPAAVAGSRSMPAGVPAGGRRGFAWQAMAQALGRRGAVRMDRFLRVADAPLRGLRRPLSARAARPGHWPAPWTRPRLRFSPGSRGRAVAAHASDLRFAGGRTPAPAAVRRPEAPKRWPAPGLAWTPRRARKPPALAVLPIRTATLLALALALALALALALALALLPRQLARGLAXWSAAGRRQAPRAGRREASRSARRCSRRALRPLSFRRPCRTVAWAPAVGARAGPVRRRSAARAAAEGGQGCRTTRAEPYPRRSA

SEQ ID NO: 3036 - protein, 68 aa, Streptococcus pneumoniae
  misc_feature (B) LOCATION 1...68
  hypothetical: YES
TITAGQIGKYQLEEIKTIVKRNSNTISFLTETSSFLDRISSAITLRKASKTTIDTTVSSKLFNNRVVI

SEQ ID NO: 3037 - protein, 302 aa, Streptococcus pneumoniae
  misc_feature (B) LOCATION 1...302
  hypothetical: YES
ELTADSPLFMVKTMTIATIDIGGTGIKFASLTPDGKILYKTSISTPENLEDLLAWLDQRLSEQDYSGIAMSVPGAVNQETGVIDGFSAVPYIHGFSWYEALSSYQLPVHLENDANCVGLSELLAHPDLENAACVVIGTGIGGAMIINGRLHRGRHGLGGEFGYMTTLAPAEKLNNWSQLASTGNMVRYVIEKSGHTDWDGRKIYQEAAAGNALCQEAIERMNRNLAQGLLNIQYLIDPDVISLGGSISQNPDFIQDVKKAVDNFVDTYEEYTVAPVIQTCTYHADANLYGALVNWLQEEKQW

SEQ ID NO: 3038 - protein, 67 aa, Streptococcus pneumoniae
  misc_feature (B) LOCATION 1...67
  hypothetical: YES
RTTARMAAFIPGASPPLVKTAIRFILVYAPFSFNILLDYITFDFKILLFSVFLAINRFHNDFIQFLL

SEQ ID NO: 3039 - protein, 794 aa, Streptococcus pneumoniae
  misc_feature (B) LOCATION 1...794
  hypothetical: YES
GKTARHHTMFEMLGNFSIGDYFRDEAITWAYELLTSPEWFDFPAEKLYMTYYPDDKDSYNRWIEVGVDPSHLIPIEDNFWEIGAGPSGPDTEIFFDRGEAFDPENIGLRLLAEDIENDRYIEIWNIVLSQFNADPAVPRSEYKELPHKNIDTGAGLERLVAVIQGAKTNFETDLFMPIIREVEKLSGKVYDQDGDNMSFKVIADHIRSLSFAIGDGALPGNEGRGYVLRRLLRRASMHGQKLGINEPFLYKLVPTVGKIMESYYPEVLEKRDFIEKIVKSEEESFARTLHSGQHFAQGIVADLKEKGQSVIAGQDVFKLYDTYGFPVELTEEIAEEAGMTVDREGFEAAMKEQQERARASAVKGGSMGMQNETLQNITVESVFNYNASQLSSKLVAIVADNAEVGAVSEGTASLIFAETSFYAEMGGQVADYGQILDESGKVVATVTNVQKAPNGQALHTVEVLAPLALNQEYTLAIDSNRRHRVMKNHTATHLLHAALHNILGNHATQAGSLNEVEFLRFDFTHFQAVTAEELRAIEQQVNEKIWEALEVKTVETDIDTAKEMGAMALFGEKYGKEVRVVTIGDYSIELCGGTHVGNTSEIGLFKIVKEEGIGSGTRRILAVTGKEAFEAYREQEDALKAVAATLKAPQVKEVPHKVEGLQEQLRQLQKENAELKEKAAAAAAGDIFKDVKEVNGHRYIASQVSVSDAGALRTFADNWKQKDYSDLLVLVAAIGDKVNVLVASKTKDLHAGNLVKELAPIIDGRGGGKPDMAMAGGSNQAKIQELLDAVAGKL

SEQ ID NO: 3040 - protein, 309 aa, Streptococcus pneumoniae
  misc_feature (B) LOCATION 1...309
  hypothetical: YES
YNYFMIITIPIKNQKDIGTPSDSVVVLGYFDGIHKGHQELFRVANKAARKDLLPIVVMTFNESPKIALEPYHPDLFLHILNPAERERKLKREGVEELYLLDFSSQFASLTAQEFFATYIKAMNAKIIVAGFDYTFGSDKKTAEDLKDYFDGEVIIVPPVEDEKGKISSTRIRQAILDGNVKEAGKLLGAPLPSRGMVVHGNARGRTIGYPTANLVLLDRTYMPADGVYVVDVEIQRQKYRAMASVGKNVTFDGEEARFEVNIFDFNQDIYGETVMVYWLDRIRDMTKFDSVDQLVDQLKADEEVTRNWS

SEQ ID NO: 3041 - protein, 200 aa, Streptococcus pneumoniae
  misc_feature (B) LOCATION 1...200
  hypothetical: YES
VNYLNKMERNINMKKWQTCVLGAGSLLCLTACSGKSVTSEHQTKDEMKTEQTASKTSAAKGKEVADFELMGVDGKTYRLSDYKGKKVYLKFWASWCSICLASLPDTDEIAKEAGDDYVVLTVVSPGHKGEQSEADFKNWYKGLDYKNLPVLVDPSGKLLETYGVRSYPTQAFIDKEGKLVKTHPGFMEKDAILQTLKELA

SEQ ID NO: 3042 - protein, 63 aa, Streptococcus pneumoniae
  misc_feature (B) LOCATION 1...63
  hypothetical: YES
NFYAKSLGINFYLFLPTHLSTILLRKHGPISKSTSKRYYQVVAIPFTRLFCPALVSIDYSRLK

SEQ ID NO: 3043 - protein, 77 aa, Streptococcus pneumoniae
  misc_feature (B) LOCATION 1...77
  hypothetical: YES
NFYARSLGINFYLFLPTHLSTILLRKHGLISKSTSKRYYQVAIPFMRLFCPALVSIDYSSRIQLGKKLLNIWRVLLG

SEQ ID NO: 3044 - protein, 235 aa, Streptococcus pneumoniae
  misc_feature (B) LOCATION 1...235
  hypothetical: YES
MIYAGILAGGTGTRMGISNLPKQFLELGDRPILIHTIEKFVLEPSIEKIVVGVHGDWVLHAEDLVDKYLPLHKERIIITKGGADRNTSIENIIEAIDAYRPLTPEDIVVTHDSVRPFITLRMIQDSIKLAQNHDAVDTVVEAVDTIVESTNGQFITGIPNRAHLYQGQTPQTFRCKDFMDLYGSLSDEEKEILTDACKIFVIKGKDVALAKGEYSNLKITTVTDLKIAKSMIEKD

SEQ ID NO: 3045 - protein, 340 aa, Streptococcus pneumoniae
  misc_feature (B) LOCATION 1...340
  hypothetical: YES
EMHAKMRNKTQIHLGIIFVICLGLLITIFLSLKLGTKEINIRDFLAAFGMGNTNDDFIKSIIYKRIPRTIFAILAGSSLAISGVLMQSVTRNPIADPGILGINTGASLSVVIGLSFLGISSSISHISFAIIGGLVSVIFVYAIAVSGKAGLTPIKLALSGTCVSMALSSFVSFLILPNNNVLDKFRFWQIGSLGAATLSSISTLLPFIILGHLIAIFISSDLNALAMGDEMAVGLGVNVNRIRSLAIIASVLLCSSITAIGGPIGFVGLIVPHFCGLFISKDIRTMTISSSFIGAELLLICDIIGRMLGKPGEIEVGIITAIIGGPVLIYVTMKNRGVNN

SEQ ID NO: 3046 - protein, 180 aa, Streptococcus pneumoniae
  misc_feature (B) LOCATION 1...180
  hypothetical: YES
SHDAQNTVLRWQIELTKSAQNTVLRWQIELTKSAQNTVLRWQIELTKSAQNTVLRWQIELTKSAQNTVLRWQIELTKSAQNTVLRWQIELTKSAQNTVLRWQIELTKSAQNTVLRWQIELTKSAQNTVLRWQIELTKSAQNTVLRWQIELTKSAQNTVLRWQIELTKSVTYIRQGEADVV

SEQ ID NO: 3047 - protein, 100 aa, Streptococcus pneumoniae
  misc_feature (B) LOCATION 1...100
  hypothetical: YES
PLDAGQRFRYGVSIIPDDYDPIAYVVSKSMEPKIRNSDYLFIKNTPQIDYNTIGIFQVDGANYVKKLRQGYLKKTQSQIPRHPPRRKQPYSYHRESCQAI

SEQ ID NO: 3048 - protein, 251 aa, Streptococcus pneumoniae
  misc_feature (B) LOCATION 1...251
  hypothetical: YES
KYCAFVPLWCFDLCMENYALEMEDLFEYIGYLLDNFRRNTVNLRLHGVNNYLPFIGHDDLKLKFVKVHQKPFLEDVISHADYLFLKRSLKKDGILKRHFVVWFLGATGARVSELIKLKVEHVEIGYFDIYSKGGKIRRLYIPKKLRNSCLSWLESENRRSGYLFLNKFNEPITARGVAQQLKNYADKYKMNPKVIYPHSFRHLFAKNFLAKYNDIALLADLMGHESIETTRIYLRKTATEQQNIVDKIVNW

SEQ ID NO: 3049 - protein, 149 aa, Streptococcus pneumoniae
  misc_feature (B) LOCATION 1...149
  hypothetical: YES
KIYLTRTSSMTSPLLESRRQLRKCAFQALMSLEFGTDVETACRFAYTHDREYTDVQLPAFLIDLVSGVQAKKEELDKQITQHLKAGWTIERLTLVERNLLRLGVFEITSFDTPQLVAVNEAIELAKDFSDQKSARFINGLLSQFVTEEQ

SEQ ID NO: 3050 - protein, 282 aa, Streptococcus pneumoniae
  misc_feature (B) LOCATION 1...282
  hypothetical: YES
MIFATSQVNPLTNSSVRNLRPKQRRLFMFWNLVHYEFKNVNKWYLALYAAVLVLSALIGIQTQGFKNLPYQESQATMLLFLATVFGGLMLTLAISTIFLIIKRFKGSVYDRQGYLTLTLPVSEHHIITAKLIGAFIWSLISTAVLALSAVIILALTAPEWIPLSYVITFVETHLPQIFLTGISFLLNTISGILCIYLAISIGQLFNEYRTALAVAAYIGIQIVIGFIELFFNLSSNFYVNSLVGLNDHFYMGAGIAIVKELIFIAIFYLGTYYILRNKVNLL

SEQ ID NO: 3051 - protein, 90 aa, Streptococcus pneumoniae
  misc_feature (B) LOCATION 1...90
  hypothetical: YES
DCLATTLLDNLCYFRINFLKVIADILQGENQLLKQVLHGKLMIGILKENANLLDTCDDRKLTDLAPIYQDLTTIGKRTDLGNDLKKAGFS

SEQ ID NO: 3052 - protein, 125 aa, Streptococcus pneumoniae
  misc_feature (B) LOCATION 1...125
  hypothetical: YES
KSIALKKQLANHSGKKKFHAMKAQAIVTSQGRIVSLDITVNYCHDMKLFKMSCRNIGQAGKILADSGYQGLMKIYPQAQTPRKSSKLKPLTAEDKAYNHALSKERSKVENIFAKVKTFKMFSTTY

SEQ ID NO: 3053 - protein, 149 aa, Streptococcus pneumoniae
  misc_feature (B) LOCATION 1...149
  hypothetical: YES
KSIALKKQLANDFGKKKFHAMKAQAIVTSQGRIVSLDIAVNYCHDMKLFKMSRRNIGQAGKILADSGYQGPMKIYPQAQTPRKSSKLKPLTVEDKACNHALSKERSKVENIFAKVKTFKMFSTTYRNHRKRFGLRMNLIAGIINHELGF

SEQ ID NO: 3054 - protein, 149 aa, Streptococcus pneumoniae
  misc_feature (B) LOCATION 1...149
  hypothetical: YES
KSIALKKELANYSGKKKCYAMKAQAIVTSQGRIVSLDITVNYCHDMKLFKMSRRNIGQAGKILADSGYQGLMKIYPQAQTPRKSSKFKPLTVEDKTYNHALSKERSKVENIFAKVETFKMFSTTYRNHRKRFGLRMNLIAGIINHELGF

SEQ ID NO: 3055 - protein, 322 aa, Streptococcus pneumoniae
  misc_feature (B) LOCATION 1...322
  hypothetical: YES
IMVAKLTDVAKLAGVSPTTVSRVINKKGYLSEKTIQKVNEAMRELGYKPNNLARSLQGKSAKLIGLIFPNISNVFYAELIDKLEHQLFKNGYKTIICNSEHDSEKEREYIEMLEANQVDGIISGSHNLGIEDYNRVTAPIISFDRNLSPDIPVVSSDNYAGGVLAAQTLVKTGAQSIIMITGNDNSNSPTGLRHAGFASVLPKAPIINVSSDFSPVRKEMEIKNILTREKPDAIFASDDLTAILVIKIAQELGISVPKELKVIGYDGTYFIENYYPQLATIKQPLEEIACLTIDLLLQKIEGKEVATTGYFLPVTLLPGKSI

SEQ ID NO: 3056 - protein, 330 aa, Streptococcus pneumoniae
  misc_feature (B) LOCATION 1...330
  hypothetical: YES
VAVAIPLELLVFTISTGVKSQIHQDFHPWTMKYQGLKTSIRLSQRLLLLAEIVSSVLVPIPMSRLVPSNQLLKRVLLQPSVLTITCNSLVKLKIVEKPIKKSAKKFQNKEKPMSQYKIAPSILAADYANFEREIKRLEATGAEYAHIDIMDSHFVPQISFGAGVVESLRPHSKMVFDCHLMVSNPEHHLEDFARAGADIISIHVEATPHIHGALQKIRSLGVKPSVVINPGTPVEAIKHVLHLVDQVLVMTVNPGFGGQAFLPETMDKVRELVALREEKGLNFEIEVDGGIDDQTIAQAKEAGATVFVAGSYVFKGEVNERVQTLRKQLD

SEQ ID NO: 3057 - protein, 170 aa, Streptococcus pneumoniae
  misc_feature (B) LOCATION 1...170
  hypothetical: YES
TNYFGRKKMKNRFYYYQLLDEREEQLFNKAGSESFYICIALSLLSYIISVLAPSLFNSNMLLIVIIIGTFYFFNRARYLGVTYYSRFHFTILGCFFLTLAITALLMLQNYQFNIEIYQHNPLNFKYLSAWVITYVIYLPWVFIGNLGLKSYGEWAQKKFEQDMDELESGE

SEQ ID NO: 3058 - protein, 60 aa, Streptococcus pneumoniae
  misc_feature (B) LOCATION 1...60
  hypothetical: YES
FIPATLFHFILFENLFKPHGQLLSSTPTIVCAVETTCGARLPLCLTLVMFLLTISDCHCK

SEQ ID NO: 3059 - protein, 65 aa, Streptococcus pneumoniae
  misc_feature (B) LOCATION 1...65
  hypothetical: YES
GGTALPTPSHGSIFCVWAFFYPSFALSFIRALSRFDELEFYLQLLPPTKSKQKGWTNTKKASNTQ

SEQ ID NO: 3060 - protein, 169 aa, Streptococcus pneumoniae
  misc_feature (B) LOCATION 1...169
  hypothetical: YES
KSYAKAQLNEKIFLLGCQRFLLRRLEMLRDLQETDVKAICDINQETLGYTFSPEETASQLARLSQDSHHFLLGYEDAANHVLLGYVHAEVYESLYSKAGFNILALAVSPQAQGQGIGKSLLQGLEQEAKRCGYGFIRLNSANHRLGAHAFYEKVGYTCDKMQKRFIRIF

SEQ ID NO: 3061 - protein, 132 aa, Streptococcus pneumoniae
  misc_feature (B) LOCATION 1...132
  hypothetical: YES
ENYANQVAANRFVILLKTKSEENMAYTEEQIENIKTRILTALEEVIDPELGIDIVNLGLIYEIRFDGDTGQTEIDMTLTTMGCPLADLLTDQIYDAMIEVPEVTDTEVKLVWYPAWTVEKMSRYARIAIGIK

SEQ ID NO: 3062 - protein, 110 aa, Streptococcus pneumoniae
  misc_feature (B) LOCATION 1...110
  hypothetical: YES
MKNALVFHQNTFPLFLLEIKFIYVTKTFIILVYYLLSIEKAVYLNYTLNLQKSLKIEMRFHTLFYIIWGYNNTYHEIYTVGVTHITNRSKNGLRQLRRIPSIQLPCADER

SEQ ID NO: 3063 - protein, 334 aa, Streptococcus pneumoniae
  misc_feature (B) LOCATION 1...334
  hypothetical: YES
IPCATVSLPLKMAVSFVTNQKESMDTMISRFFRHLFEALKSLKRNGWMTVAAVSSVMITLTLVAIFASVIFNTAKLATDIENNVRVVVYIRKDVEDNSQTIEKEGQTVTNNDYHKVYDSLKNMSTVKSVTFSSKEEQYEKLTEIMGDNWKIFEGDANPLYDAYIVEANTPNDVKTIAEDAKKIEGVSEVQDGGANTERLFKLASFIRVWGLGIAALLIFIAVFLISNTIRITIISRSREIQIMRLVGAKNSYIRGPFLLEGAFIGLLGAIAPSVLVFIVYQIVYQSVNKSLVGQNLSMISPDLFSPLMIALLFVIGVFIGSLGSGISMRRFLKI

SEQ ID NO: 3064 - protein, 122 aa, Streptococcus pneumoniae
  misc_feature (B) LOCATION 1...122
  hypothetical: YES
SRCAAWRSVCSCAAARTRSNWRPWARSARSRRRRRTRNSSARLMRRGSATARRPVRNRWFRGYPGAATGGSPRSSRWPGRLRCPGLSGIRRSSAATRLPRTSPAIRASVRPHGADRRRRSGS

SEQ ID NO: 3065 - protein, 158 aa, Streptococcus pneumoniae
  misc_feature (B) LOCATION 1...158
  hypothetical: YES
SGLAKNPLLLQLIFIYYVLPSIGIRLDRLPAAIIAFVLNYAAYFAEIFRGGIDTIPRGQYEAAKVLKFSPFDRVRYIILPQVTKIVLPSVFNEVMSLVKDTSLVYALGISDLILASRTAANRDASLVPMFLAGAIYLILIGIVTIISKKVEKKYSYYR

SEQ ID NO: 3066 - protein, 522 aa, Streptococcus pneumoniae
  misc_feature (B) LOCATION 1...522
  hypothetical: YES
VCLAIDILSLIKFLGDFVMDYNFNLEHPFFFTNNDYSTDTSIKYQVSLPFNWHEVMNNDEWVYQYPIGKFVERQGWKIHISSEYNSSHELLQDVAKICHEMRIPFKHLSTEDKFIMRNGKLVSRGFSGKFITCYPNQNELESVLQRLESALKQYNGPYILSDKRWDEAPIYLRYGVFRPSRDDEKKVAIDELIVGDEVVKDERLPVFKIPKGIVPPDFLNKWLDKKDKKQGDFPFIIDNAIRFSNSGGIYNARLKEDGKKIILKEARPYTGLGFDGTYSSEKLASECKALKILNEWSETPKIYWHGKIWEHTFLGIEHMKGVPLNRWVTNNFPLYEVVDKTKDYLLRVSKIVEKLIDLTNKFHSENVYHQDLHLGNILVKDEDEISIIDWEQAVFSNDEKVVHKVAAPGFRAWRETLPSEIDWYGIRQIAHYLYMPLVTTSDLTYNYVSQTRIEGKKLFESLGYTREHIDYVESLLSYLDSKCPQIENISRKKVLKPMHEIRTIESEQDIQDFIIKAFLLVN

SEQ ID NO: 3067 - protein, 309 aa, Streptococcus pneumoniae
  misc_feature (B) LOCATION 1...309
  hypothetical: YES
ERLALSFQTKSKPFRLFFVILEKYIYRIFALFLGKSDVFLVSTVKVLKKKGTIMSVLEIKDLHVEIEGKEILKGVNLTLKTGEIAAIMGPNGTGKSTLSAAIMGNPNYEVTKGEVLFDGVNILELEVDERARMGLFLAMQYPSEIPGITNAEFLRAAMNAGKEDDEKISVREFITKLDEKMELLNMKEEMAERYLNEGFSGGEKKRNEILQLLMLEPTFALLDEIDSGLDIDALKVVSKGVNAMRGEGFGAMIITHYQRLLNYITPDVVHVMMEGRVVLSGGPELAARLEREGYAKLAEELGYDYKEEL

SEQ ID NO: 3068 - protein, 130 aa, Streptococcus pneumoniae
  misc_feature (B) LOCATION 1...130
  hypothetical: YES
HFIAIAVIDLLLFAFFIIRLETSFEWLLLSDLIFFLTQGLLLFLLIVRLKHQFAEIYPQINKKIRFYYLGVLTIDFLFFVLLAFISSQRFSSLMPIITACHSTFYYMTADYLRENYPDFYDKHISLWECL

SEQ ID NO: 3069 - protein, 276 aa, Streptococcus pneumoniae
  misc_feature (B) LOCATION 1...276
  hypothetical: YES
ARSAGMHYDASYISFDGILRKEILMTLLDVKHVQKIYKTRFQGNQVEALKDIHFTVEKGDYVAIMGESGSGKSTLLNILAMLDKPSRGQVYLNGTDTATIKNSQASSFRREKLGFVFQDFNLLDTLSVKDNILLPLVLSRRPITEMMKKLVVTAENLGINQLQEKYPYEISGGQKQRVAVARAIITEPEILLADEPTGALDSKSSAALLDVFDEINERGQTILMVTHSTAAASRAKRVLFIKDGILYNQIYRGEKTERQMFQEISDTLTVMASEVN

SEQ ID NO: 3070 - protein, 345 aa, Streptococcus pneumoniae
  misc_feature (B) LOCATION 1...345
  hypothetical: YES
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDRQKMAMESGATAVVAERGQEGITKVREILGGGADAALECVGTEAAIEQALGVLHNGGRMGFVGVPHYNNRALGSTFMQNISVAGGAASATTYDKQFLLKAVLDGDINPGRVFTSSYKLEDIDQAYKDMDERKTIKSMIVIE

SEQ ID NO: 3071 - protein, 147 aa, Streptococcus pneumoniae
  misc_feature (B) LOCATION 1...147
  hypothetical: YES
AATARPRLPGENRSRGRVHGAGQCPGLAARADSGRRRPRRGASATRRNRSIRTAPRRPSACAIACHANPRRPPAGTPAGIEREPATAAGRSRAPARCRAGAHPGRQRSRKPCGAPAGATAPARRRGGAGPAWPWPVAGRLHHEPGGP

SEQ ID NO: 3072 - protein, 86 aa, Streptococcus pneumoniae
  misc_feature (B) LOCATION 1...86
  hypothetical: YES
RITAILKRSGLIINKKKVQRLVQKLKLQVKSYSRKSRKYSSYKGQVGKISDNKIKRNIYYRKKGEIESSTNRLIYSKKIFTRWKNS

SEQ ID NO: 3073 - protein, 282 aa, Streptococcus pneumoniae
  misc_feature (B) LOCATION 1...282
  hypothetical: YES
KMTAGQTKLATMVNPEVMADMVAAKLPKLIKFTPLAYVETKLEGQPGSTLTVPAWEYAGDATEIEEGQAITPDQLTTKKTTMTIKKAGKGYEITDESLLSGLGDPLGQATYQLGLAIANKIDNDLVAVAKTATQHITETPTTLEAIDKALDIFEDEEDAQYVAIINPKDATKLKTAVAKEWIKGSELGANMVVSGTFGEVDGVQIVRSKKVDEGKGFLVKVSPSQTQTDDANKYGAFVILLKRDVAIETDRDILKKTTVITGDEHYGVYLYDPTRVVKFGGA

SEQ ID NO: 3074 - protein, 154 aa, Streptococcus pneumoniae
  misc_feature (B) LOCATION 1...154
  hypothetical: YES
KWTAVQELERTLRGVEMITIKKQEIVKLEDVLHLYQAVGWTNYTHQPEMLEHALSHSLVIYLALDGDAVVGLIRLVGDGFSSVFVQDLIVLPIYQRQGIGSALMKEALKDYKDAYQVQLVTEETEKNVGFYRSMGFEILSTYNCIGMTWANREK

SEQ ID NO: 3075 - protein, 71 aa, Streptococcus pneumoniae
  misc_feature (B) LOCATION 1...71
  hypothetical: YES
RYQAKKSIAAIKNSFFPRLEGAILLAIDYFYTLRKSLQTTSALPCRIYVTDFVMSYLQPQNSVLSSLRLAS

SEQ ID NO: 3076 - protein, 191 aa, Streptococcus pneumoniae
  misc_feature (B) LOCATION 1...191
  hypothetical: YES
KKQAYDEKNKKVIYLLLDEKRKNYVEDKRQNFPSLPNWKMDLFSEEEKRNYFQTTCEISSKDSAINKYKMEKIIKRSNKGNVYRAIRKSDGQKVIIKQSRPFVNYDAEGEWTALDDIKNEAHMLKKLADKSYTTNLTDEFYIVDDYFLVQEQVDGLNFEEFIRETEHSLNIREKTLYNIVNIVSDIHKLGI

SEQ ID NO: 3077 - protein, 66 aa, Streptococcus pneumoniae
  misc_feature (B) LOCATION 1...66
  hypothetical: YES
KMQAFYIKKEKKLSNDYHEINTGNQSNFYENVKDNEIKYFLTKVSNLFFKEFLMKQSKTINLKLAH

SEQ ID NO: 3078 - protein, 476 aa, Streptococcus pneumoniae
  misc_feature (B) LOCATION 1...476
  hypothetical: YES
QMYLGDLMEKAECGQFSILSFLLQESQTTVKAVMEETGFSKATLTKYVTLLNDKALDSGLELTIHSEDENLRLSIGAATKGRDIRSLFLDSAVKYQILVYLLYHQQFLAHQLAQELVISEATLGRHLAGLNQILSEFDLSIQNGRWRGPEHQIRYFYFCLFRKVWSSQEWEGHMQKPERKQEIANLEEICGASLSAGQKLDLVLWAHISQQRLRVNACQFQVIEEKMRGYFDNIFYLRLLRKVPSFFAGQHIPLGVEDGEMMIFFSFLLSHRILPLHTMEYILGFGGQLADLLTQLIQEMKKEELLGDYTEDHVTYELSQLCAQVYLYKGYILQDRYKYQLENRHPYLLMEHDFKETAEEIFHALPAFQQGTDLDKKILWEWLQLIEYMAENGGQHMRIGLDLTSGFLVFSRMAAILKRYLEYNRFITIEAYDPSRHYDLLVTNNPIHKKEQTPVYYLKNDLDMEDLAGIRQLLFT

SEQ ID NO: 3079 - protein, 511 aa, Streptococcus pneumoniae
  misc_feature (B) LOCATION 1...511
  hypothetical: YES
VAKARWNSIQMSVTFFIGEQRLKTKIGLASICLLGLATSHVAANETEVAKTSQDTTTASSSSEQNQSSNKTQTSAEVQTNAAAHWDGDYYVKDDGSKAQSEWIFDNYYKAWFYINSDGRYSQNEWHENYYLKSGGYMAQNEWIYDSNYKSWFYLKSDGAYAHQEWQLIGNKWYYFKKWGYMAKSQWQGSYFLNGQGAMMQNEWLYDPAYSAYFYLKSDGTYANQEWQKVGGKWYYFKKWGYMARNEWQGNYYLTGSGAMATDEVIMDGARYIFAASGELKEKKDLNVGWVHRDGKRYFFNNREEQVGTEHAKKIIDISEHNGRINDWKKVIDENEVDGVIVRLGYSGKEDKELAHNIKELNRLGIPYGVYLYTYAENETDAENDAKQTIELIKKYNMNLSYPIYYDVENWEYVNKSKRAPSDTDTWVKIINKYMDTMKQAGYQNVYVYSYRSLLQTRLKHPDILKHVNWVAAYTNALEWENPYYSGEKGWQYTSSEYMKGIQGRVDVSVWY

SEQ ID NO: 3080 - protein, 103 aa, Streptococcus pneumoniae
  misc_feature (B) LOCATION 1...103
  hypothetical: YES
IERACKSYRRRIWCNCRYFCSCCCSXMLDAGAAKDSFDVELTSAGDKKVGVIKVVREITGLGLKEAKELVDGAPALVKDGVATAEAEEIKAKLEEAGASVTLK

SEQ ID NO: 3081 - protein, 219 aa, Streptococcus pneumoniae
  misc_feature (B) LOCATION 1...219
  hypothetical: YES
RRRANDYKKANITIEEYIEMSEVDFNEAVNYEFTSDTCQLANSIYQSLFKFFDKKNFSGDLIFTWKSPSLVKEGDYIGKRDSQVDNLRVIGNIFPNYLTNRKYSLNMNRNGCMGDFPHDFFDIYLDHVAKYAYEQKVNNIKEYYPLKRAILHQENALYFRFFSNFDDFLEKNYLKTIWQVSKETPFSEMDFNMFKNISEKIIFERGSKMLNDLKSNYKK

SEQ ID NO: 3082 - protein, 336 aa, Streptococcus pneumoniae
  misc_feature (B) LOCATION 1...336
  hypothetical: YES
YNRAMSRILDNEIMGDEELVERTLRPQYLREYIGQDKVKDQLQIFIEAAKMRDEALDHVLLFGPPGLGKTTMAFVIANELGVNLKQTSGPVIEKAGDLVAILNELEPGDVLFIDEIHRLPMSVEEVLYSAMEDFYIDIMIGAGEGSRSVHLELPPFTLIGATTRAGMLSNPLRARFGITGHMEYYAHADLTEIVERTADIFEMEITHEAASELALRSRGTPRIANRLLKRVRDFAQIMGNGVIDDIITDKALTMLDVDHEGLDYVDQKILRTMIEMYSGGPVGLGTLSVNIAEERETVEDMYEPYLIQKGFIMRTRSGRVATAKAYEHLGYEYSEK

SEQ ID NO: 3083 - protein, 94 aa, Streptococcus pneumoniae
  misc_feature (B) LOCATION 1...94
  hypothetical: YES
LNRANRGEKISGPPLLDDNEETKILPTSSSRFGYANPKDHGFSQETLKIQVEPSIHKSRRIENTKRNVFNSKLNKILFAVIFLLILLVLAMKLL

SEQ ID NO: 3084 - protein, 264 aa, Streptococcus pneumoniae
  misc_feature (B) LOCATION 1...264
  hypothetical: YES
SMRAPMSPFKKMGKPKSRRAISVLEHVCISYDGKHPILDDISFSVNKGETIAFVGHTGSGKSSIINVLMRFYEFQSGRVLLDDVDIRDFSQEELRKNIGLVLQEPFLYHGTIKSNIAMYQEISDEQVQAAAAFVDADSFIQELPQGYDSPVSERGSSFSTGQRQLFAFARTVASQPKILILDEATANIDSETESLVQASLAKMRQGRTTIAIAHRLSTIQDANCIYVLDKGRIIESGTHEELLTLGGTYHKMYSLQAGAMAYTL

SEQ ID NO: 3085 - protein, 80 aa, Streptococcus pneumoniae
  misc_feature (B) LOCATION 1...80
  hypothetical: YES
NQGALPLIHKEVFMTHYVANPEVVILEGGIMGQEAILKPKIRAALKEVLVPSLAENTRLEFAHHQNTAGMLGAYYHFKIK

SEQ ID NO: 3086 - protein, 230 aa, Streptococcus pneumoniae
  misc_feature (B) LOCATION 1...230
  hypothetical: YES
EGGASMKKIYSFLAGIAAIILVLWGIATHLDSKINSRDSQKLVIYNWGDYIDPELLTQFTEETGIQVQYETFDSNEAMYTKIKQGGTTYDIAIPSEYMINKMKDEDLLVPLDYSKIEGIENIGPEFLNQSFDPGNKFSIPYFWGTLGIVYNETMVDEAPEHWDDLWKPEYKNSIMLFDGAREVLGLGLNSLGYSLNSKDLQQLEETVDKLYKLTPNIKAIVADEMKGYMI

SEQ ID NO: 3087 - protein, 73 aa, Streptococcus pneumoniae
  misc_feature (B) LOCATION 1...73
  hypothetical: YES
VALAKEQDIPFKLDIYPFYGSDASAAMSAGAEVKHALLGAGIESSHSYERTHIDSVVATERIVDAYLKSEAVS

SEQ ID NO: 3088 - protein, 377 aa, Streptococcus pneumoniae
  misc_feature (B) LOCATION 1...377
  hypothetical: YES
ISLASSKPSSISYFSVAFDALCIINRIGEVMADDKLRATPAARKLADDLGINLYDVSGSGANGRVHKEDVETYKDTNVVRISPLAKRIALEHNIAWQEIQGTGHRGKIMKKDVLALLPENIENDSIKSPAQIEKVEEVPDNVTPYGEIERIPMTPMRKVIAQRMVESYLTAPTFTLNYEVDMTEMLALRKRVLEPIMEATGKKTTVTDLLSLAVVKSLMKHPYINASLTEDGKTIITHNYVNLAMAVGMDNGLMTPVVYNAEKMSLSELVVAFKDVIGRTLDGKLAPSELQNSTFTISNLGMFGVQSFGPIINQPNSAILGVSSTIEKPVVVNGEIVIRPIMSLGLTIDHRVVDGMAGAKFMKDLKELIETPISMLI

SEQ ID NO: 3089 - protein, 277 aa, Streptococcus pneumoniae
  misc_feature (B) LOCATION 1...277
  hypothetical: YES
KELAITGFLMNKMNKVMLTMFGLVMLPLLFACSNNQSAGIEAIKSKGKLVVALNPDFAPFEYQKVVDGKNQIVGSDIELAKAIATELGVELELSPMSFDNVLASVQSGKADLAISGVSKTDERSKVFDFSTPYYTAKNKLIVKKSDLATYQSVNDLAQKKVGAQKGSIQETMAKDLLQNSSLVSLPKNGNLITDLKSGQVDAVIFEEPVAKGFVENNPDLAIADLNFEKEQDDSYAVAMKKDSKELKEAVDKTIQKLKESGELDKLIEDAFKASIEK

SEQ ID NO: 3090 - protein, 93 aa, Streptococcus pneumoniae
  misc_feature (B) LOCATION 1...93
  hypothetical: YES
TWLAGLSPTKITTKPGTRPVSSFNFAVFSANCPCNLAAKAFPSIICVISLLFSFKYLPLYQKLQVPSNTSFLGYPIVSNYKKKLWLNFSLILS

SEQ ID NO: 3091 - protein, 94 aa, Streptococcus pneumoniae
  misc_feature (B) LOCATION 1...94
  hypothetical: YES
PRLAIPTRFLSSVPKSKGIQASMSRKGNSQDNGMMESFFGILKSEMFYGYEKTFKSLNQLEQAIVDYIDYYNNKRIKVKLKGLSLVQYRTKSFG

SEQ ID NO: 3092 - protein, 438 aa, Streptococcus pneumoniae
  misc_feature (B) LOCATION 1...438
  hypothetical: YES
EIMALPTIAIVGRPNVGKSTLFNRIAGERISIVEDVEGVTRDRIYATGEWLNRSFSMIDTGGIDDVDAPFMEQIKHQAEIAMEEADVIVFVVSGKEGITDADEYVARKLYKTHKPVILAVNKVDNPEMRNDIYDFYALGLGEPLPISSVHGIGTGDVLDAIVENLPNEYEEENPDVIKFSLIGRPNVGKSSLINAILGEDRVIASPVAGTTRDAIDTHFTDTDGQEFTMIDTAGMRKSGKVYENTEKYSVMRAMRAIDRSDVVLMVINAEEGIREYDKRIAGFAHEAGKGMIIVVNKWDTLEKDNHTMKNWEEDIREQFQYLPYAPIIFVSALTKQRLHKLPGMIKQISESQNTRIPSAVLNDVIMDAIAINPTPTDKGKRLKIFYATQVATKPPTFVIFVNEEELMHFSYLRFLENQIRKAFVFEGTPIHLIARKRK

SEQ ID NO: 3093 - protein, 96 aa, Streptococcus pneumoniae
  misc_feature (B) LOCATION 1...96
  hypothetical: YES
QSMARKETMAERKYCKMKKDIHPEYRPVVFMDTTTGYQFLSGSTKRSNETVEFEGETYPLIRVEISSDSHPFYTGRQKFTQADGRVDRFNKKYGLK

SEQ ID NO: 3094 - protein, 273 aa, Streptococcus pneumoniae
  misc_feature (B) LOCATION 1...273
  hypothetical: YES
ESMAKERVDVLAYKQGLFETREQAKRGVMAGLVVAVLNGERFDKPGEKIPDDTELKLKGEKLKYVSRGGLKLEKALQVFDLSVDGATTIDIGASTGGFTDVMLQNSAKLVFAVDVGTNQLAWKLRQDPRVVSMEQFNFRYAEKTDFEQEPSFASIDVSFISLSLILPALHRVLADQGQVVALVKPQFEAGREQIGKNGIIRDAKVHQNVLESVTAMAVEVGFSVLGLDFSPIQGGHGNIEFLAYLKKEKSASNQILAEIKEAVERAHSQFKNE

SEQ ID NO: 3095 - protein, 162 aa, Streptococcus pneumoniae
  misc_feature (B) LOCATION 1...162
  hypothetical: YES
KKMASLYELTGQFLTIYQLDIDDETKADTLEAIDWQEQFEQKAEGYAHVIKNLEADVAMYKAEEESFKAKKQVAQKKLDYVKDNIMAAMNVTGQTEVKSGALIIKIAKNPESVKVNEDDLPKKYFTKKVTLAPDKKTLKELLKSGKKVKGAELVRTEKLVIK

SEQ ID NO: 3096 - protein, 166 aa, Streptococcus pneumoniae
  misc_feature (B) LOCATION 1...166
  hypothetical: YES
MKTAFIIIDVQNVLVETGFQTKSLLEKISYLQNQARSKNIEIIYVQHIENSEAQTSEDWQLSALLNRKPAEKVFQKKYNSIFKETGLKEYLDKQGIEKLVLCGMQTEYCVDTSVKVAFEYGYQLIVPEGAVTTFDGDDIPAETINEFYEDIWEERFADVLDYKHIF

SEQ ID NO: 3097 - protein, 84 aa, Streptococcus pneumoniae
  misc_feature (B) LOCATION 1...84
  hypothetical: YES
QPAASFLVCTLIFIEYYLISSPFERAWFDICFDQPASPSLHKHHRRLPSHPVLESSIFQYHFLLHPKQINRLLGGKYKVRWLRS

SEQ ID NO: 3098 - protein, 615 aa, Streptococcus pneumoniae
  misc_feature (B) LOCATION 1...615
  hypothetical: YES
STAAYSKYTTWALAVANCAKYNIRRSKMKTVQFFWHYFKVYKFSFVVVILMIVLATFAQALFPVFSGQAVTQLANLVQAYQNGNPELVWQSLSGIMVNLGLLVLVLFISSVIYMCLMTRVIAESTNEMRKGLFGKLAQLTVSFFDRRQDGDILSHFTSDLDNILQAFNESLIQVMSNIVLYIGLILVMFSRNVTLALITIASTPLAFLMLIFIVKMARKYTNLQQKEVGKLNAYMDESISGQKAVIVQGIQEDMMAGFLEQNERVRKATFKGRMFSGILFPVMNGMSLINTAIVIFAGSAVLLNDKSIETSTALGLIVMFAQFSQQYYQPIIQVAASWGSLQLAFTGAERIQEMFDAEEEIRPEKAPTFTKLQESVEISHIDFSYLPDKPILKDVSISAPKGQMTAVVGPTGSGKTTIMNLINRFYDVDAGGIYFDGKDIRGYDLDSLRSKVGIVLQDSVLFSGTIRDNIRFGVPDASQEMVEVAAKATHIHDYIESLPDKYDTLIDDDQSIFSAGQKQLISIARTLMTDPEVLILDEATSNVDTVTESKIQHAMEVVVAGRTSFVIAHRLKTILNADQIIVLKDGEVIERGNHHELLKLGGFYSELYHNQFVFE

SEQ ID NO: 3099 - protein, 69 aa, Streptococcus pneumoniae
  misc_feature (B) LOCATION 1...69
  hypothetical: YES
NSQAEDIQTLKIKFSMVGFGEGLLKGWQAIDTKIADILLKSINIRLTEVSIQISSKKIDQILLTKTVTF

SEQ ID NO: 3100 - protein, 204 aa, Streptococcus pneumoniae
  misc_feature (B) LOCATION 1...204
  hypothetical: YES
VIKALIVGVAINGISIIGFKTVGNVNRIAVLILKIDGIIASLPNVLFARLLLNRKRQIARPIVAPPPPINTNKSLNGNVIMCWSVCPAATASWFSVVNCNQTGSTKAFKTCPPLTPQNQKNEFTITHRIIPGSVPAINLSGVPTIAPRNPLRPPATPAASRPFKTKAHKTKVVKPGKRAENDLLTTSGTPLGIFIVIPRWINIR

SEQ ID NO: 3101 - protein, 185 aa, Streptococcus pneumoniae
  misc_feature (B) LOCATION 1...185
  hypothetical: YES
EVEAYLLDKLKHPKVVALGEIGLDYHWMTAPKEVQEQVFRRQIQLSKDLDLPFVVHTRDALEDTYEIIKSEGVGPRGGIMHSFSGTLEWAEKFVDLGMTISFSGVVTFKKATDLQEAAKELPLDKMLVETDAPYLAPVPKRGRENKTAYTRYVVDFIADLRGMTTEELAVATTANAERIFGLDSK

SEQ ID NO: 3102 - protein, 166 aa, Streptococcus pneumoniae
  misc_feature (B) LOCATION 1...166
  hypothetical: YES
IKEADMNLKQALIDNDSIRLGLEANNWKEAVKVAVDPLIESGAILPEYYDAIIESTEEYGPYYILMPGMAMPHARPEAGVQSDAFSLITLQNPVVFSDGKEVSVLLALAATSSKIHTSVAIPQIIALFELEDSIARLQACQTKEDVLAMIEESKDSPYLEGLDLES

SEQ ID NO: 3103 - protein, 295 aa, Streptococcus pneumoniae
  misc_feature (B) LOCATION 1...295
  hypothetical: YES
NMRAKELQDWFPEARISDQPVEKEGYLTLPLASQQWILLEEAGLSEREKQLVALLTQQEQARSLNPWYSYLVEGKGQAPQVFKKIQLVYCHLSYFQQENLASWLDMMRTLFPNCQTVLQVGAQDYVFVLQQDKYTSVRDILSDTIEAVEYDFGLRLSIMLGQVWSQTGHQALSDLIKAERDLFKTWWRQGHQGVHTFSQLYLWSMGERLVDLKPIKECLHQMILDQDQIQEIILSLWENSAVLTKTAQQLYLHRNSLQYKIDKWEELTGLQLKELTDLTLCYQLILGSLSTIVGL

SEQ ID NO: 3104 - protein, 136 aa, Streptococcus pneumoniae
  misc_feature (B) LOCATION 1...136
  hypothetical: YES
KKRAFMTYEYKSHIYLAETALNVKDLASQTAFYQQVIGLEILSQTETESILGLGGKVLVQLIQAQESGEVREYYGLYHLAILLPTRKALADVLKHLTDLQIPLVGGADHGYSEAIYLEDLEGNGIELYRDKPFSTW

SEQ ID NO: 3105 - protein, 132 aa, Streptococcus pneumoniae
  misc_feature (B) LOCATION 1...132
  hypothetical: YES
RAGAPDNISTPSSSPVLLPTSPVPTLARGARPAAPPSAAGRSLPRSAATKRSSRPPHTHPPPPRPTPTRHNPERATQPSTDSKATSHPRPARDPRAPAPRPPAPHRERKPSHPDPPTHHRGPASPKKFQQSQ

SEQ ID NO: 3106 - protein, 372 aa, Streptococcus pneumoniae
  misc_feature (B) LOCATION 1...372
  hypothetical: YES
SFHLDREEIHMRIFASPSRYIQGENALFENAKSILDLGNYPILLCDQLVYDIVGKRFEDYLHRYGFHIVLALFNGEASDNEINRVVALAEKENCDSIIGLGGGKTIDSAKAIADLIEKPVIIAPTIASTDAPVSALSVIYTDEGAFDHYLFYSKNPDLVLVDTKVISQAPKRLLASGIADGLATWVEARAVMQANGKTMLGQQQTLAGVAIAKKCEETLFADGLQAMAACEAKVVTPALENIVEANTLLSGLGFESGGLAAAHAIHNGFTALTGDIHHLTHGEKVAYGTLVQLLLENRPKEELDKYIEFYKKIGMPTTLKEMHLDQVGYDDLIKVGKQATMEGETIHQMPFKISPSDVAQAIIAVDAYVNSK

SEQ ID NO: 3107 - protein, 62 aa, Streptococcus pneumoniae
  misc_feature (B) LOCATION 1...62
  hypothetical: YES
ITHLGGNFMKKKILIIFILYLIMSIFLYPLRESIWYQLFYTIAYVIAVMIYFALTKKKGAKK

SEQ ID NO: 3108 - protein, 123 aa, Streptococcus pneumoniae
  misc_feature (B) LOCATION 1...123
  hypothetical: YES
GWTXVVRWWVGVAWFSLPVGGXGSRGGGPGVPCGAGVARRLAVCAGLRGALWVVAGGRGPGRGGVRVWWPAAPFGCRGSGEAAAGCAGGCGGSRPSRQSGDGGGGEEYRTRGWRAYVVRRPRP

SEQ ID NO: 3109 - protein, 363 aa, Streptococcus pneumoniae
  misc_feature (B) LOCATION 1...363
  hypothetical: YES
DCNFLTGMILSLTVHTYFIIFSAENYYRKVTKRIKSLFIFKAWLILEKCGIIFLMEKIVITATAESIEQVEQLLEAGVDRIYVGEKDFGLRLPTTFSYDQLREIAKLVHDAGKELIVAVNALMHQDMMDRIKPFLDFLEEIKTDYITIGDAGVFYVVNRDGYSFKTIYDASTMVTSSRQINFWGQKAGASEAVLAREIPSAELFKMPEILEIPAEVLVYGASVIHHSKRPLLQNYYNFTHIDDEKTHKRDLFLAEPSDPESHYSIFEDNHGTHIFANNDLDLMIKLTELVEHGFTRWKLEGLYTPGQNFVEIAKLFIQARNLIQEGNFSHDQVFLLDEEVRKLHPKNRFLDTGFYDYDPDMVR

SEQ ID NO: 3110 - protein, 86 aa, Streptococcus pneumoniae
  misc_feature (B) LOCATION 1...86
  hypothetical: YES
FCFFYLYSMKIKEQTRKLAAGCSKHCFEVVDRTDEVSSKHVFEVVDETDEVSSKHCFEVVDETDEVSNHTYGRATLTWFEEIFEEY

SEQ ID NO: 3111 - protein, 73 aa, Streptococcus pneumoniae
  misc_feature (B) LOCATION 1...73
  hypothetical: YES
KLNFMKAIFFIILFAFQTYLIYLSISISDKKQKTIELTSLNCFVILFLIYDKLIFLFIAYVFLIIFILNLFRN

SEQ ID NO: 3112 - protein, 343 aa, Streptococcus pneumoniae
  misc_feature (B) LOCATION 1...343
  hypothetical: YES
IKNLENLRIEKRTNLMAKDIRVLLYYLYTPIENAEQFAADHLAFCKSIGLKGRILVADEGINGTVSGDYETTQKYMDYVHSLPGMEDLWFKIDEESEQAFKKMFVRYKKEIVHLGLEDNDFDNDINPLETTGAYLSPKEFKEALLDKDTVVLDTRNDYEYDLEHFRGAIRPDIRNFRELPQWVRDNKEKFMDKRVVVYCTGGVRCEKFSGWMVREGYKDVGQLHGGIATYGKDPEVQGELWDGKMYVFDERIAVDVNHVNPTIVGKDWFDGTPCERYVNCGNPFCNRRILTSEENEDKYLRGCSHECRVHPRNRYVSKNELTQAEVIERLAAIGESLDQAATV

SEQ ID NO: 3113 - protein, 327 aa, Streptococcus pneumoniae
  misc_feature (B) LOCATION 1...327
  hypothetical: YES
FHFYYGGFLYYLTNPIVTFLNKVCKLNRLLGILITLCTLVWGMVIGVVYLLPILINQLSSLIISSQTIYSRVQDLIIDLSNYPALQNLDVEATIQQLNLSYVDILQNILNSVSNSVGSVLSALISTVLILIMTPVFLVYFLLDGHKFLPMLERTILKRDRLHIAGLLKNLNATIARYISGVSIDAIIIGCLAYIGYSIIGLKYALVFAIFSGVANLIPYVGPSIGLIPMIIANIFTDPHRLLIAVIYMLVVQQVDGNILYPRIVGSVMKVHPITILVLLLLSSNIYGVVGMIVAVPTYSILKEISKFLSRLYENHKIMKERERELAK

SEQ ID NO: 3114 - protein, 115 aa, Streptococcus pneumoniae
  misc_feature (B) LOCATION 1...115
  hypothetical: YES
KSFYGLSTIDSVYSYAMQHLTSQNYPDIIFVSGDEKVQGLIRACYEKGILIPDDISIIGFNNIPISQYYTPALSTIAPNYVKLAKEMIEGVLAIIKGESVTSVEVSPKFVRRQIF

SEQ ID NO: 3115 - protein, 102 aa, Streptococcus pneumoniae
  misc_feature (B) LOCATION 1...102
  hypothetical: YES
TKFYRRKTMDWYDYMIQASKQSQFNASHWFRYLRKVIFEDYSYLTNQDVEKLLDSKELTRFQKISLKYAFQEHTPTHKYVISLNKPAKLTNVQKLMEKYKHG

SEQ ID NO: 3116 - protein, 229 aa, Streptococcus pneumoniae
  misc_feature (B) LOCATION 1...229
  hypothetical: YES
KHFLFHSSKEEVYRMNEIITLKNIELKLKKTCVFQNLNFSCKQGEIIGITGANGSGKSVLFKLIAGLYSPSYGEVLINGENIVPERKIPANLGALIEEPGFINYYSGFKNLQYLASIRGVVGNQEINDTLKIVGLYEQKDQKVKTYSLGMRKKLGIAQAIMENPSILLLDEPMNALDKSSVENMRTLFRKLSSEKGTTILIASHSEEDIRILCDKVYAIEDKVCTLCSD

SEQ ID NO: 3117 - protein, 155 aa, Streptococcus pneumoniae
  misc_feature (B) LOCATION 1...155
  hypothetical: YES
IILYTRKQEVHSVLASKKSVKLFYSMLLLINVLGAVLVLSDNLFIKNTLQQELVDFLLPSFFFLFGLDLLIFLPLKKYVRDFLAMLDRKKTVLVTILATLLFLRNPMTIVSLLIYIGLGLFFAAYLVPNSVKKEVSFYGHIFRDLVLVIVTLIFF

SEQ ID NO: 3118 - protein, 205 aa, Streptococcus pneumoniae
  misc_feature (B) LOCATION 1...205
  hypothetical: YES
VILYYKYLGFSLEKIAELLKEERTDLLPHLTRQLDYLTRERQHLDTLISTLQKTIQEQKGERKMTIEEKFTGFSYQDNQKYHQEAVEKYGQEVMGQALERQKGHEDEATAAFNQVFQTLAQNLQVGLPATATENQEQAAKLLQAIRTYGFDCSIEVFGHIGKGYVYNPNFKENIDKFGSGTAQYTSDAIAGLRSDKCRINRLGIS

SEQ ID NO: 3119 - protein, 65 aa, Streptococcus pneumoniae
  misc_feature (B) LOCATION 1...65
  hypothetical: YES
LYLYTFLKLFEQIFHKNESFSYQPIHDIFLLNIMESHSVKELQVALSREHVVHQTIHHNISNQLR

SEQ ID NO: 3120 - protein, 62 aa, Streptococcus pneumoniae
  misc_feature (B) LOCATION 1...62
  hypothetical: YES
LKLYRVQNSAMNSIWVLTSKKKLVCVALIPLQPSLTQKSSSQLLAHQQVMSTVVKARLEMEP

SEQ ID NO: 3121 - protein, 315 aa, Streptococcus pneumoniae
  misc_feature (B) LOCATION 1...315
  hypothetical: YES
DYIYLHTTKCKHFCLKLRIKSMKKAMVIINPTSGGEKALDYKEKLENKAKEYFEYVETKITEKALDATHFAEEASREQYDAVVVFGGDGTVNEVISGIDERDYIPKLGIIPGGTGNLITKLLEINQDIDGAIDELDFDLTNKIDIGKANDNYFGYIFSIGSLPEAIHNVEIEDKTKFGILTYAVNTMKSVMTDQVFNIKVETENGNYVGEASHVLVLLTNYFADKKIFEENKDGYANILILKDASIFSKLSVIPDLLKGDVIANDNIEYIKARNIKISSDSELESDVDGDKSDNLPVEIKVLAQRVEVFSKPKED

SEQ ID NO: 3122 - protein, 65 aa, Streptococcus pneumoniae
  misc_feature (B) LOCATION 1...65
  hypothetical: YES
PPFLKNSKFWVIDETDERLGPFNTFEEAYQSLLFYLKMTEDEYQSNYTAQELVYIYKEEKKPCRR

SEQ ID NO: 3123 - protein, 381 aa, Streptococcus pneumoniae
  misc_feature (B) LOCATION 1...381
  hypothetical: YES
NMIYFDNSATTRPYPEALETYMQVASKILGNPSSLHRLGDQATRILDASRQQIADLIGKKSDEIFFTSGGTEGDNWIIKGVAFEKAQFGKHIIVSAIEHPAVKESALWLKAQGFEVDFAPVDNKGFVDVEALEDLIRPDTTLVSIMAVNNEIGSVQPIEAISKLLADKPTISFHVDAVQALAKIPTEKYLTERVDFATFSGHKFHGIRGVGFIYIKSGKKITPLLTGGGQERDYRSTTENVAGIAATAKALRLSMEKLDIFRSKTGQMKAVIRQALLDYPDIFVFSDEEDFAPHILTFGIKGVRGEVIVHAFEDYDIFISTTSACSSKAGKPAGTLIAMGVDKDKAQSAVRLSLDLENDMSQVEQFLTKLKLIYNQTRKVR

SEQ ID NO: 3124 - protein, 370 aa, Streptococcus pneumoniae
  misc_feature (B) LOCATION 1...370
  hypothetical: YES
KRNFHIFTFVSRYRASISTSTCKRMCEIERTGKGMNADDTVTIYDVAREAGVSMATVSRVVNGNKNVKENTRKKVLEVIDRLDYRPNAVARGLASKKTTTVGVVIPNITNGYFSSLAKGIDDIAEMYKYNIVLANSDEDNEKEVSVVNTLFSKQVDGIIYMGYHLTDKIRSEFSRSRTPIVLAGTVDVEHQLPSVNIDYKQATIDAVSYLAKENERIAFVSGPLVDDINGKVRLVGYKETLKKAGITYSEGLVFESKYSYDDGYALAERLISSNATAAVVTGDELAAGVLNGLADKGVSVPEDFEIITSDDSQISRFTRPNLTTIAQPLYDLGAISMRMLTKIMHKEELEEREVLLPHGLTERSSTRKRK

SEQ ID NO: 3125 - protein, 71 aa, Streptococcus pneumoniae
  misc_feature (B) LOCATION 1...71
  hypothetical: YES
QRFLYVREYRTYEEIAADFGIHESNLLRRSQWVEVTLVQSGVTISKTHLSAENTVIVDATEVKINRPKKIN

SEQ ID NO: 3126 - protein, 132 aa, Streptococcus pneumoniae
  misc_feature (B) LOCATION 1...132
  hypothetical: YES
QRNFAYNLSTSPNLEQVKAMLNQAFTEKHYENTILHSDQGWQYQHDFYHRFLESKGIQPSMSRKGNSPDNGMMESFFGILKSEMFYGYEKNFRSLENLEQAIVDYIDYYNNKRIKVKLKGLSPVQYRTKSFG

SEQ ID NO: 3127 - protein, 129 aa, Streptococcus pneumoniae
  misc_feature (B) LOCATION 1...129
  hypothetical: YES
AIFLTVLKTMVKQLVQQPRNNTGSKYPYTIDVTGEVGDLKQGFSVNIEVKSKTKAILVPVSSLVMDDSKNYVWIVDEQQKAKKVEVSLGNADAENQEITSGLTNGAKVISNPTSSLEEGKEVKADEATN

SEQ ID NO: 3128 - protein, 223 aa, Streptococcus pneumoniae
  misc_feature (B) LOCATION 1...223
  hypothetical: YES
WPFLLSTWATRLSRWILRRIARPLAWRKSLWHLITMWTPSVSWQTVAMSSLMSLKMSTLTVWMPLSRMTTPSRNRFCRISQNRILEKDFLSNKAQVTVAPYKVVTSSLDLADIDMSKNYVLKTATGGYDGHGQKVIRSEADLEAAYALADSDSCVLEEFVNFDLEISVIVSGNGKEVTFFPVQENIHRNNILSKTIVPARISESLVDNHKTMAVESQNKTQLV

SEQ ID NO: 3129 - protein, 283 aa, Streptococcus pneumoniae
  misc_feature (B) LOCATION 1...283
  hypothetical: YES
KGNFMIIKRILNHNAVIAQSKKDIDILLFGRGIAFGRKTGDKVNPIDIEKSFFLKNRDNMTRFTEMFINVPLELVYITEKIINLGKITLGNNFDEIIYINLTDHISSSIERYKEGIIISNPLRWEISKYYKEEFELGKRALQIIKKELGIELPIDEAAFIALHFVNANLENNFQESYKITEIIMGIEKIIQDFYCTEFNQDSIDYYRFITHIKLFAHRLVENTTYCDDDDEDLLALMKNKYPREYECGEQVAMFIQTEYNYLLTSSELVYLMANIRRLTKNLD

SEQ ID NO: 3130 - protein, 452 aa, Streptococcus pneumoniae
  misc_feature (B) LOCATION 1...452
  hypothetical: YES
FFSYCFNPFICGKIRLLSLKRIPMKLQKPKGTQDILPAESAKWQYVEGFAREIFKRYNYAEVRTPIFEHYEVISRSVGDTTDIVTKEMYDFYDKGDRHITLRPEGTAPVVRSYVENKLFAPEVQKPSKFYYMGPMFRYERPQAGRLRQFHQIGVECFGSSNPATDVETISMAAYFLKEIGIQGVKLHLNTLGNPESRAAYRQALIDYLTPLKETLSKDSQRRLEENPLRVLDSKEKEDKVAVENAPSILDFLDEESQTHFDAVRQMLENLGVDYIIDTNMVRGLDYYNHTIFEFITEIEGNDLTVCAGGRYDGLVAYFGGPETAGFGFGLGVERLLLILEKQGVALPIENALDVYIAVLGDGANVKALELVQALRQQGFKAERDYLNRKLKAQFKSADVFAAKTLITLGESEVESGQVTVKNNQTREEVQVSLETISQNFSEIFEKLGFYTQ

SEQ ID NO: 3131 - protein, 244 aa, Streptococcus pneumoniae
  misc_feature (B) LOCATION 1...244
  hypothetical: YES
NNSYLLERWRDMRWLFRLIGAFFSFVWRLFWRLVWIVVLLCVLAFGLLWYLNGDFQGALKQAERSVKIGQQSIDQWEKTGQLPKLSQTDSHQHSEGRWPQASARIYLDPQMDSRFQEAYLEAIQNWNQTGAFNFELVTESSKADITATEMNDGGTPVAGEAESQTNLLTGQFLSVTVRLNHYYLSNPYYGYSYERLVHTAEHELGHAIGLDHTDEKSVMQPAGSFYGIQEEDVANLRKIYETSE

SEQ ID NO: 3132 - protein, 93 aa, Streptococcus pneumoniae
  misc_feature (B) LOCATION 1...93
  hypothetical: YES
LRFLHSINFLELVVVTRVTRQLLIFHMIDNIDNVIEEWNIVRNENKGILIVLEIALEPINMLSIQVVGRLVQQQNIRLFKEKFCQKHLGSLPT

SEQ ID NO: 3133 - protein, 269 aa, Streptococcus pneumoniae
  misc_feature (B) LOCATION 1...269
  hypothetical: YES
TESYNKRVIKANTMTGFIHFKDLDGASVGNSHPSTSPGGTHYFKTKSAIKTEPLASGTVIDYYYPGEKVHYDQILEKDGYKWLSYTAYNGSYRYVQLEAVNKNPLGNSVLSSTGGTHYFKTKSAIKTEPLVSATVIDYYYPGEKVHYDQILEKDGYKWLSYTAYNGSRRYIQLEGVTSSQNYQNQSGNISSYGSNNSSTVGWKKINGSWYHFKSNGSKSTGWLKDGSSWYYLKLSGEMQTGWLKENGSWYYLGSSGAMQTGSTSIVRRA

SEQ ID NO: 3134 - protein, 155 aa, Streptococcus pneumoniae
  misc_feature (B) LOCATION 1...155
  hypothetical: YES
MNTYEGNLVANNIKIGIVVARFNEFITSKLLSGALDNLKRENVNEKDIEVAWVPGAFEIPLIASKMAKSKKYDAIICLGAVIRGNTSHYDYVCSEVSKGIAQISLNSEIPVMFGVLTTDTIEQAIERAGTKAGNKGSECAQGAIEMVNLIRTLDA

SEQ ID NO: 3135 - protein, 98 aa, Streptococcus pneumoniae
  misc_feature (B) LOCATION 1...98
  hypothetical: YES
VSTYPFLKEKSEDIWPSSDFFYFPQFHVIHLDDEQISCSFLYGIDKMPQVARTLDLPRLTDLLLSEGDSFDPNGSFPLQIFPFLLNSVLVAELLALAF

SEQ ID NO: 3136 - protein, 320 aa, Streptococcus pneumoniae
  misc_feature (B) LOCATION 1...320
  hypothetical: YES
METYYKAINWNAIEDVIDKSTWEKLTEQFWLDTRIPLSNDLDDWRKLSNKEKDLVGKVFGGLTLLDTMQSETGVQALRADIRTPHEEAVFNNIQFMESVHAKSYSSIFSTLNTKAEIEEIFEWTNTNPYLQKKAEIVNEIYLNGSPLEKKVASVFLETFLFYSGFFTPLYYLGNNKLANVAEIIKLIIRDESVHGTYIGYKFQLGFNELPEEEQEKLKEWMYDLLYTLYENEEGYTESLYDGVGWTEEVKTFLRYNANKALMNMGQDPLFPDSAEDVNPIVMNGISTGTSNHDFFSQVGNGYLLGEVEAMQDDDYNYGLD

SEQ ID NO: 3137 - protein, 96 aa, Streptococcus pneumoniae
  misc_feature (B) LOCATION 1...96
  hypothetical: YES
WRTYVLKIRYHKQFKKDFKLAMKRGLKAELLEEVLNFLVQEKEHPARYRDHSLTASKHFQGVRECHTQPDWLLVYKVDKSELILNLLRTGSHSDLF

SEQ ID NO: 3138 - protein, 331 aa, Streptococcus pneumoniae
  misc_feature (B) LOCATION 1...331
  hypothetical: YES
VFLLTYPFYFIRLFERLLYRLQTSYYAYYANFESKLPYFTYILSTFTVYAMCMYLATKPKKLQATAVLVSFIAANTIHLAIGTRNPFILSILFAFVYYFMREQTEKGKWIGFKEKLAIFVGSPILMLAMGVLNYVRDNVQVSHTGFWDILLDFIYKQGTSFGVLARGFLFNSSLPYRDFRNFTFGPVLDYFARGSLGAIFGGKAFEHTTNSVELAIDSNSYAHNISYLVLNKEYLKGHGIESSYIMELYTDYGMIGVFLLSFLLGVLYIAMLQVAYRSRTILFALSILILNNLFFMPRSSFSESFFNLFTMQFWGIVLVIIFVAKMLTKEN

SEQ ID NO: 3139 - protein, 125 aa, Streptococcus pneumoniae
  misc_feature (B) LOCATION 1...125
  hypothetical: YES
ELLLDPLYRLHVSVIFLEREQAISTEXYLAHLFLHFHKNQDHITSLLFSKNDYFLRQLHKELEHHVYSVLADNLKEAHPNMPTSYLQHLVVSNFIETLTWWLKKGQDFTGQEVVQFYLDLLIPKN

SEQ ID NO: 3140 - protein, 68 aa, Streptococcus pneumoniae
  misc_feature (B) LOCATION 1...68
  hypothetical: YES
NGYYKKWSEIDDDTFRKSFYVSSALPCCVLSKLRLASEFDFHLLEMKLMRDISRHLSQDIMENDKKSS

SEQ ID NO: 3141 - protein, 456 aa, Streptococcus pneumoniae
  misc_feature (B) LOCATION 1...456
  hypothetical: YES
KIYYERALIMLLNFLFIFIFLLIIITFILFEGDLFQPAVILTLAYFISIASALVNRNVWGTELHFKTFGLILLGVATFIIVSLLTKLSYKPKVEGISYKELKEINPSKIIYGILLILNLVMLFLYIHEIQKVVLFSGRGFSNITDLISNYRYLSYYSNEVEDRVSGMINQLAKIIPATTFVSLYIFINNYFITKQIKKNFIYLIPIAIFFVYAIISGGRLPLIRLVIGTLLILYIYSVYGSHKSQLTRSFKMITRSLFAFLMLIVLFFLLKFVLGRSSQEDFISYITRYMGGSIQLFDLFVIDPIRRNKELGAETFSGIYEMLAKLGFDNNIIKGLEWRISPNYYSLGNVYTAIRRYYSDFGVIGIVICQSFTAWLYTLGYEKIRHHSLVTNGQRFRLILLAASFYPLFLNSIEDVFYISMVTIGYGIQIVIFYLVFWVLLKVQVDFNKGKLRINR

SEQ ID NO: 3142 - protein, 292 aa, Streptococcus pneumoniae
  misc_feature (B) LOCATION 1...292
  hypothetical: YES
SLHYDCDSGRFSLFSLDWSHPMIRFLVLAGYFELTIYLHLSGKLNQYINMHYSYLAYISMVLSFILAIVQLYIWMKQVKTHSHLNSRLAKMTSISLLAIPLVIGLTFPTVSLDSQTVSAKGYHFPLSEGTDLAIQTSEGTTSQYLKPDTSSYFSKSAYEKEMRTAADKYLSQDSIQITNENYMEVMEAIYDYPDEFEGKTIQFTGFVYNDPSHANSQFLFRFGIIHCIADSGVYGLLTKGNTRQYENNTWITAKGKLVNHYHKELKQNLPTLEIDSFTKVDKPENPYVYRAF

SEQ ID NO: 3143 - protein, 458 aa, Streptococcus pneumoniae
  misc_feature (B) LOCATION 1...458
  hypothetical: YES
RTHYPSWIRLLHRRIQMKFRKLACTVLAGAAVLGLAACGNSGGSKDAAKSGGDGAKTEITWWAFPVFTQEKTGDGVGTYEKSIIEAFEKANPDIKVKLETIDFKSGPEKITTAIEAGTAPDVLFDAPGRIIQYGKNGKLAELNDLFTDEFVKDVNNENIVQASKAGDKAYMYPISSAPFYMAMNKKMLEDAGVANLVKEGWTTDDFEKVLKALKDKGYTPGSLFSSGQGGDQGTRAFISNLYSGSVTDEKVSKYTTDDPKFVKGLEKATSWIKDNLINNGSQFDGGADIQNFANGQTSYTILWAPAQNGIQAKLLEASKVEVVEVPFPSDEGKPALEYLVNGFAVFNNKDDKKVAASKKFIQFIADDKEWGPKDVVRTGAFPVRTSFGKLYEDKRMETISGWTQYYSPYYNTIDGFAEMRTLWFPMLQSVSNGDEKPADALKAFTEKANETIKKAMKQ

SEQ ID NO: 3144 - protein, 202 aa, Streptococcus pneumoniae
  misc_feature (B) LOCATION 1...202
  hypothetical: YES
VGLLECPTFLLKKEFFMLKKWQLKDVILLAFLSIFFGGVFVGSGYVYNILSLLLTPLGLQAFANEILFGLWCMAAPIAAIFVPRVGSATIGEVLAALAEVLYGSQFGLGALLSGLVQGLGSEFGFIVTKNRYESWLSLTANSIGVTLVSFVYEYIKLGYYAFSLPFVLSLLVVRFISVYFFCTILVRAIVKLYHQFATGGKA

SEQ ID NO: 3145 - protein, 224 aa, Streptococcus pneumoniae
  misc_feature (B) LOCATION 1...224
  hypothetical: YES
RDNYYNPVIVQPLVLIGAPDVKEMPKDWTELGSKYKGKYSIYGLQGGTGRAILASILVRYLDEKGDLGVSEKGWEVAKEYFANAYTLQKGESSVVKALDKESPIQYGMIWGSGALIGQKEQNVEFKVMTPEIGVPFVTEQTMVLSTSKKQALAKEFIDWFGQSEIQVEYSKKFGSIPANKDALKELPEDTKKFVDQVKPQNIDWEAVGKHLDEWVEKAELEYVK

SEQ ID NO: 3146 - protein, 87 aa, Streptococcus pneumoniae
  misc_feature (B) LOCATION 1...87
  hypothetical: YES
NMNYFRKRRERQAKSNSGIYCPAANRSKIQYETKEKADHAVQYDNGGLVRSYYCRTCACWHTTSKSNKPPLSLKNYGLKLFGLDKSE

SEQ ID NO: 3147 - protein, 284 aa, Streptococcus pneumoniae
  misc_feature (B) LOCATION 1...284
  hypothetical: YES
QHLLHHQKVGKSKMTNSNYKLTKEDFNQINKRSLFTFQLGWNYERMQASGYLYMILPQLRKMYGDGTPELKEMMKVHTQFFNTSPFFHTIIAGFDLAMEEKDGVGSKDAVNGIKTGLMGPFAPLGDTIFGSLVPAIMGSVAATMAIAGQPWGIFLWIAVAVAYDIFRWKQLEFAYKEGVNLINNMQSTLTALIDAASVLGVFMMGALVATVINFEISYKLPIGEKMIDFQDILNQIFPRLLPAIFTAFIFWLLGKKGMNSTKAIGIIIVLALALSALGHFALGM

SEQ ID NO: 3148 - protein, 510 aa, Streptococcus pneumoniae
  misc_feature (B) LOCATION 1...510
  hypothetical: YES
KLLLSLTIRKKNAFSSFGLRFIIRVSKSGGKKMTTFKDGFLWGGAVAAHQLEGGWQEGGKGISVADVMTAGRHGVAREITLGVLEGKYYPNHEAIDFYHRYKEDIALFAEMGFKCFRTSIAWTRIFPKGDELEPNEEGLQFYDNLFDECLKNGIEPVITLSHFEMPYHLVTEYGGWKNRKLIDFFARFAEVIFKRYKDKVKYWMTFNEINNQANYQEDFAPFTNSGIVYEEGDNREAIMYQAAHYELVASARAVKIGHEINPDFQIGCMIAMCPIYPATCNPKDILMAMKAMQKRYYFADVHVLGKYPEHIFKYWERKGISVDFTAQDKEDLLGGTVDYIGFSYYMSFAIDSHRENNPYFDYLETEDLVKNNYVKASEWEWQIDPEGLRYALNWFTDHYHLPLFIVENGFGAIDKVAADGMVHDDYRIEYLGAHIREMKKAVVEDGVDLMGYTPWGCIDLVSAGTGEMRKRYGFIYVDKDDNGKGSYNRSPKKSFGWYKEVISSNGESVE

SEQ ID NO: 3149 - protein, 65 aa, Streptococcus pneumoniae
  misc_feature (B) LOCATION 1...65
  hypothetical: YES
KTLLKKKHNKMKRQNLASRKRKKKIRKQQLRTLLHLLQVNLPLKMKNSPILQLQKIILNENQRTN

SEQ ID NO: 3150 - protein, 311 aa, Streptococcus pneumoniae
  misc_feature (B) LOCATION 1...311
  hypothetical: YES
TRCYSLECFRKTVLKPLTFSNNKAGFELLDLSFRQLNQDCLIALKLLSDPNREQFQHDNRQVELKILARHIHRLKKKQSDWKVQYTRCLDIIFPELDKIVGKHSEYTYQLLTRYPNPQKRLEAGFDKLIEIKRLTASKIQDILSVAPRSIGTTSPAREFEIIEIIKHYKRLIDKAETCVNDLMAEFNSVITTVTGIGGRLGAVILAEIRNIHAFDNPAQLQAFAGLDSSIYQSGQIDLAGRMIKRGSPHLRWALIQAAKACARFSPAFKVYLKTKLEQGKHYNVAIIHLAKKLIRTLFYILKKSCHLTNKK

SEQ ID NO: 3151 - protein, 69 aa, Streptococcus pneumoniae
  misc_feature (B) LOCATION 1...69
  hypothetical: YES
CNRYQKSKKEFLDGYQNKKGGNYEKVFKNIERQLDLSLDGFARGTLVDSILLHSSIWERGCLQRLPHDQ

SEQ ID NO: 3152 - protein, 95 aa, Streptococcus pneumoniae
  misc_feature (B) LOCATION 1...95
  hypothetical: YES
SQLLFIYKILPVQRQGLSRLLFYFVHPCFFFLGLGVGSWLYIAKIRSYRNILLSSSSTQIISLAPLYGNSKEDWSILSKTACTGLTKSDRHKYRQ

SEQ ID NO: 3153 - protein, 188 aa, Streptococcus pneumoniae
  misc_feature (B) LOCATION 1...188
  hypothetical: YES
WRLLPFEKALVIMDRGYESYNLMAHFQEKGWLYIIRIRDGKQSMPSSFNLPNTECFDQKVSLKLSRKQTNQLKKLYRDFPNDYHFIPHNSIFDFLPETSRKQDPVTLYELPFRMVRLEVEEGKYETLVTNTDYSVQELKNLYASRWGIETSFRDLKYSIGLVNFHAKKKGGISKKSLLALQILTFVVG

SEQ ID NO: 3154 - protein, 227 aa, Streptococcus pneumoniae
  misc_feature (B) LOCATION 1...227
  hypothetical: YES
WRLLPFEKALVIMDRGYESYNLMAHFQEKGWLYIIRIRDGKQSMPSSFNLPNTECFDQKVSLKLSRKQTNQLKKLYRDFPNDYHFIPHNSIFDFLPETSRKQDPVTLYELPFRMVRLEVEEGKYETLVTNTDYSVQELKNLYASRWGIETSFRDLKYSIGLVNFHAKKKGGILQEIFARFTNFNFCRWVTSQVAIDSSHKKQRYKVCFSDAAYACRLFFNGSLSSLQ

SEQ ID NO: 3155 - protein, 262 aa, Streptococcus pneumoniae
  misc_feature (B) LOCATION 1...262
  hypothetical: YES
WRLLPFEKALVIMDRGYESYNLMAHFQEKGWLYIIRIRDGKQSMPSSFNLPNTECFDQKVSLKLSRKQTNQLKKLYRDFPNDYHFIPHNSIFDFLPETSRKQDPVTLYELPFRMVRLEVEEGKYETLVTNTDYSVQELKNLYASRWGIETSFRDLKYSIGLVNFHAKKKGGILQEIFARFTNFNFCRWVTSQVAIDSSHKKQRYKVCFSDAAYACRLFFNGSLSSLQLKNYLKKQLSIIRPNRKYSRKIKAQSVVDFIYRVT

SEQ ID NO: 3156 - protein, 262 aa, Streptococcus pneumoniae; identical to SEQ ID NO: 3155
  misc_feature (B) LOCATION 1...262
  hypothetical: YES

SEQ ID NO: 3157 - protein, 358 aa, Streptococcus pneumoniae
  misc_feature (B) LOCATION 1...358
  hypothetical: YES
KESYIMNKRVQAFLAKMQEKELDGVIINNLKNVYYLTGFWGSNGTVFISRDRQVLVTDSRYIIAAKQETSGFEIVADRDELAVIAGIVKDMGLTRIGFEDEISVSYYHRMQAAFAGLDLFPQTQFVEGLRMIKDEAEIAAIRKACSISDQAFRDALDFIKPGKTEIEIANFLDFRMRELGASGLSFDTILASGINSSKPHAHPMHKPVELGEAITMDFGCLYDHYVSDMTRTIYLGHVSDEQAEIYNTVLKANQALIDQAKAGLGFRDFDKIPRDIIIEAGYGDYFTHGIGHGIGLDIHEEPYFSQTSTETIKTGMALTDEPGIYIEGKYGVRIEDDILITETGCELLTLAPKELIVI

SEQ ID NO: 3158 - protein, 350 aa, Streptococcus pneumoniae
  misc_feature (B) LOCATION 1...350
  hypothetical: YES
YQGYSKEQIELLVSLPSFGIMMMLLLNGFLEKIFPERLQISLGLLILSLSGTAPFWYQAYPFVFGTRLLFGLGLGMINAKAISIISERYQGKRRIQMLGLRASAEVVGASIITLAVGQLLAFGWTAIFLAYSAGFLVLPLYLLFVPYGKSKKEVKKRAKEASRLTREMKGLIFTLAIEAAVVVCTNTAITIRIPSLMVERGLGDAQLSSFVLSIMQLIGIVAGVSFSFLISIFKEKLLLWSGITFGLGQIVIALSSSLWVVVAGSVLAGFAYSVVLTTVFQLVSERIPAKLLNQATSFAVLGCSFGAFTTPFVLGAIGLLTHNGMLVFSILGGWLIVISIFVMYLLQKRA

SEQ ID NO: 3159 - protein, 139 aa, Streptococcus pneumoniae
  misc_feature (B) LOCATION 1...139
  hypothetical: YES
RIILVKKCHAMKAQAIVTSQGRIVSLDITVNYCHDMKLFKMSCRNIGQAGKILADSGYQGLMKIYPQAQTPRKSSKLKPLTVEDKACNHALSKERSKVENIFAKVKTFKIISTTYRNHRKRFGLRMNLSAGIINHELGF

SEQ ID NO: 3160 - protein, 851 aa, Streptococcus pneumoniae
  misc_feature (B) LOCATION 1...851
  hypothetical: YES
RNILKYSEFKVRKNMANILKTIIENDKGEIRRLEKMADKVFKYEDQMAALTDDQLKAKTVEFKERYQNGESLDSLLYEAFAVVREGAKRVLGLFPYKVQVMGGIVLHHGDVPEMRTGEGKTLTATMPVYLNALSGKGVHVVTVNEYLSERDATEMGELYSWLGLSVGINLATKSPMEKKEAYECDITYSTNSEIGFDYLRDNMVVRAENMVQRPLNYALVDEVDSILIDEARTPLIVSGANAVETSQLYHMADHYVKSLNKDDYIIDVQSKTIGLSDSGIDRAESYFKLENLYDIENVALTHFIDNALRANYIMLLDIDYVVSEEQEILIVDQFTGRTMEGRRYSDGLHQAIEAKEGVPIQDETKTSASITYQNLFRMYKKLSGMTGTGKTEEEEFREIYNIRVIPIPTNRPVQRIDHSDLLYASIESKFKAVVEDVKARYQKGQPVLVGTVAVETSDYISKKLVAAGVPHEVLNAKNHYREAQIIMNAGQRGAVTIATNMAGRGTDIKLGEGVRELGGLCVIGTERHESRRIDNQLRGRSGRQGDPGESQFYLSLEDDLMKRFGSERLKGIFERLNMSEEAIESRMLTRQVEAAQKRVEGNNYDTRKQVLQYDDVMREQREIIYTQRYDVITADRDLAPEIQAMIKRTIGRVVDGHARAKQDEKLEAILNFAKYNLLPEDSITMEDLSGLSDKAIKEELFQRALKVYDSQVSKLRDEEAVKEFQKVLILRVVDNKWTDHIDALDQLRNAVGLRGYAQNNPVVEYQAEGFRMFNDMIGSIEFDVTRLMMKAQIHEQERPQAERHISTTATRNIAAHQASMPEDLDLSQIGRNELCPCGSGKKFKNCHGKRQ

SEQ ID NO: 3161 - protein, 133 aa, Streptococcus pneumoniae
  misc_feature (B) LOCATION 1...133
  hypothetical: YES
DGILGIKKYRETSKDKVRKPWLEFFGNKPFTQQPQRAISQANQLLDYKSWSEEDRKMFSQLHMREEQVLLAQDYALETARAEDLEQGLERGKVEGRAERKLFAFLDIVRQGLLTSEVASQQLGMSVSEFEALL

SEQ ID NO: 3162 - protein, 373 aa, Streptococcus pneumoniae
  misc_feature (B) LOCATION 1...373
  hypothetical: YES
KRNLTMEEILCIGCGATIQTTDKAGLGFTPQSALEKGLETGEVYCQRCFRLRHYNEITDVQLTNDDFLKLLHEVGDSDALVVNVIDIFDFNGSVIPGLPRFVSGNDVLLVGNKKDILPKSVKSGKISQWLMKRAHEEGLRPVDVVLTSAQNKHAIKEVIDKIEHYRKGRDVYVVGVTNVGKSTLINAIIQEITGDQNVITTSRFPGTTLDKIEIPLDDGSYIYDTPGIIHRHQMAHYLTAKNLKYVSPKKEIKPKTYQLNPEQTLFLGGLGRFDFIAGEKQGFTAFFDNELKLHRSKLEGASAFYDKHLGTLLTPPNSKEKEDFPRLVQHVFTIKDKTDLVISGLGWIRVTGTAKVAVWAPEGVAVVTRKAII

SEQ ID NO: 3163 - protein, 272 aa, Streptococcus pneumoniae
  misc_feature (B) LOCATION 1...272
  hypothetical: YES
KRNFMSIKLIAVDIDGTLVNSQKEITPEVFSAIQDAKEAGVKVVIATGRPIAGVAKLLDDLQLRDQGDYVVTFNGALVQETATGHEIISESLTYEDYLDMEFLSRKLGVHMHAITKDGIYTANRNIGTYTVHESTLVSMPIFYRTPEEMAGKEIVKCMFIDEPEILDAAIEKIPAEFYERYSINKSAPFYLELLTKNVDKGSAITHLAEKLGLTKDETMAIGDEENDRAMLEVVGNPVVMENGNPEIKKIAKYITKTNDESGVAHAIRTWVL

SEQ ID NO: 3164 - protein, 64 aa, Streptococcus pneumoniae
  misc_feature (B) LOCATION 1...64
  hypothetical: YES
VYLYQLFLVLFLLLGGLALLFSLLALTSHKWYYVRFGKRVMLLLYYLFAHNKRELFYENLLNMP

SEQ ID NO: 3165 - protein, 64 aa, Streptococcus pneumoniae
  misc_feature (B) LOCATION 1...64
  hypothetical: YES
VYLYQPFLVLFLLLGGLALLFSLLALTSHKWYYVRFGKRVMLLLYYLFAHNKRELFYENLLNMP

SEQ ID NO: 3166 - protein, 64 aa, Streptococcus pneumoniae; identical to SEQ ID NO: 3164
  misc_feature (B) LOCATION 1...64
  hypothetical: YES

SEQ ID NO: 3167 - protein, 64 aa, Streptococcus pneumoniae
  misc_feature (B) LOCATION 1...64
  hypothetical: YES
VYLYQLFLVLFLLLGGLALLFSFLALTSHKWYYVRFGKRVMLLLYYLFAHNKRELFYENLLNMP

SEQ ID NO: 3168 - protein, 60 aa, Streptococcus pneumoniae
  misc_feature (B) LOCATION 1...60
  hypothetical: YES
FDLYSSIHTRDEPIEQVWKEIRKRGFKNKAFRTLEDIMNQLQDVIQGLGEEVIKSIVNRR

SEQ ID NO: 3169 - protein, 637 aa, Streptococcus pneumoniae
  misc_feature (B) LOCATION 1...637
  hypothetical: YES
HLIYTLILMILWMALAFAGDMRLFVKDNDQKKAEIKIRMPEKIKETKSEYPYVSSYGNVIELGEGDLSKNKPDNLTKMESGKIYSDSEKQQYLLKDNIILRKGYALKVTTYNPGKTDMLEGNGVYSKEDIAKIQKANPNLRALSETTIYADSRNVEDGRSTQAVLMSALDGFNIIRYQVFTFKMNDKGEAIDKDGNLVTDSSKLVLFGKDDKEYTGEDKSNVEAIKEDGSMLFIDTKPVNLSMDKNYFNPSKSNKIYVRNPEFYLRGKISDKGGFNWELRVNESVVDNYLIYGDLHIDNTRDFNIKLNVKDGDIMDWGMKDYKANGFPDKVTDMDGNVYLQTGYSNLNAKAVGVHYQFLYDNVKPEVNIDPKGNTSIEYADGKSVVFNINDKRNNGFDGEIQEQHIYINGKEYTSFNDIKQIIDKTLNIKIVVKDFARNTTVKEFILNKDTGEVSELKPHRVTVTIQNGKEMSSTIVSEEDFILPVYKGELEKGYQFDGWEISGFEGKKDAGYVINLSKDTFIKPVFKKIEEKKEEENKPTFDVSKKKDNPQVNHSQLNESHRKEDLQREDHSQKSDSTKDVTATVLDKNNISSKSTTNNPNKLPKTGTASGAQTLLAAGIMFIVGIFLGLKKKNQD

SEQ ID NO: 3170 - protein, 414 aa, Streptococcus pneumoniae
  misc_feature (B) LOCATION 1...414
  hypothetical: YES
SVSYLKTGIESGRFPTGSACLLSVNYSLDFHCSKDTIQRALLELRHEQYLYAKPQSGYYVLEHGQHQDLEIEVTDEHASAYDDFRLCVNETLIGRENYLFNYYDNQEGLEDLRQSIHKLLFEQALYCKANQLVLTSGTQQALFILSQISFPRQAKEILVEQPTYHRMNRLLIAQGLDYQTIERGIDGIDLEELEGHFKTGKIKFFYTIPRFHYPLGHSYSEQDKRSILNLAAKYDVYIVEDDYLGDLDSKKGQTFHYLDTEEHVIYIKSFSTSLFPALRITALILPNAIKEAFVAYKNILDYDSNLIMQKALSLYIDSQLFEKNRLARLTNHESYQKQIEERITKTPCPLPHYPLHDGLLLDLRQYPKIASLKHSQLGLDFFEEAYLSTCPYQFAKVSLDNLENVLNYLKAELE

SEQ ID NO: 3171 - protein, 126 aa, Streptococcus pneumoniae
  misc_feature (B) LOCATION 1...126
  hypothetical: YES
SVVLGFVQKSAQVSHLQQPHRSAIKITRSATSRANPISCVTITIVIPDLARSCITANTSPTISGSKAEVGSSKSKTSGTIANPRAMQSVVVAHPTDSVDKRLPYLANQLFPKALGLSSQQLPCFHL

SEQ ID NO: 3172 - protein, 165 aa, Streptococcus pneumoniae
  misc_feature (B) LOCATION 1...165
  hypothetical: YES
INPYKIRNAKLSSIRRNEVSFIFQAYNLIPSLPVIENIALPLRLSQKKLTIKNVENLLKRMKFNAGLNDFVGTLSGGEQQKVAIARAFIADSDIIFADEPTGALDSVSREVIFDLLRELVGAGKCVIMVTHDIELASKTDRALILKDGKIFKELHRLAGKSCIKS

SEQ ID NO: 3173 - protein, 157 aa, Streptococcus pneumoniae
  misc_feature (B) LOCATION 1...157
  hypothetical: YES
SMPYKRQRSFSMALSKLDSLYMAVVADHSKNPHHQGKLEDAEQTSLNNPTCGDVINLSVKFDAEDRLEDIAFLNSGCTISTASASMMTDAVLGKTKQEILELATIFSEMVQGQKDERQGQLGDAAFLSGVAKFPQRIKCATLAWNALKKTIENQEKQ

SEQ ID NO: 3174 - protein, 287 aa, Streptococcus pneumoniae
  misc_feature (B) LOCATION 1...287
  hypothetical: YES
LSAYQVVGTRMWFKSKTAWKQMQQRREKLMPKTLTEKLNAIKATGKGIFVPYIMAGDHEKGLDGLAETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLADTDIALIPLVSLTTGIERQKELIEGAEGFIYAVAINGVTGKSGNYRADLDKHLAQLHQVADIPVLTGFGVSSQADLERFNAVSDGVIVGSKIVKALHQGEPIQDFIRQAVAYQK

SEQ ID NO: 3175 - protein, 221 aa, Streptococcus pneumoniae
  misc_feature (B) LOCATION 1...221
  hypothetical: YES
INHYFILFLARMVAPAKVRRPAISSARFEIDPVDGNDFFGLFVAFSFVEAWLEGCLSLLKLFVVDGFLSSACGLLLSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSGCGLTSGFGFSSCGLTSG

SEQ ID NO: 3176 - protein, 235 aa, Streptococcus pneumoniae
  misc_feature (B) LOCATION 1...235
  hypothetical: YES
KMVLRGVPMSQIDLQKLTKKNQEFVHIATQQFIKDGKTDAEIQTIFEEVIPQILEEQSKGTTARSLYGAPTHWAHSFTVKEQYEKEHPKENDDPKLMIMDSALFITSLFALVSALTTFFAADQAFGYGLITLLLVGLVGGFAFYLMYYFVYQYYGPDMDRSQRPPFWKSVLVILASMFLWLLVFFATSFLPASLNPVLDPLPLAIIGAALLALRFYLKKRLNIRSASAGPTRYQE

SEQ ID NO: 3177 - protein, 518 aa, Streptococcus pneumoniae
  misc_feature (B) LOCATION 1...518
  hypothetical: YES
HSNYQGWDMKYRKFQLLMSKYGFSLSIMLLELCLVFGLFLYLGRMAPILWITVLILLIIITIISIFNRNTTPENKVTWLLVAFVPVFGPLLYLMFGERRLSKKEIKQLKKLGSMHFQEANSQLLKEKLKESDKAAYGVIKSLLSMDTNADIYDQTASTFFPNGEAMWKKMVEDLKKAEKFIFLEYYIIEEGLMWNRILDILEQKVAQGVEVKMLYDDIGCMATLTGDYAHRLRQLGIEAHKFNKVIPRLTVAYNNRDHRKILIVDGQIAYTGGVNLADEYINHVERFGYWKDSGIRLDGLAVKALTRLFLTTWYINRGEISDFDQYHLENHSIPSDGLTIPYGSGPKPIFRAQVGKKVYQSLINQATESVYITTPYLIIDYDLTETIKNAAMRGVDVRIITPYIPDKKFIQLVTRGAYPDFLSAGVRIYEYSPGFIHSKQMLVDEDFAVVGTINLDYRSLVHHYENAVLLYKTPSIREIARDFRNIFADSQEVYPHSIKTSWYQKLVKEIAQLFAPIL

SEQ ID NO: 3178 - protein, 62 aa, Streptococcus pneumoniae
  misc_feature (B) LOCATION 1...62
  hypothetical: YES
KLDYNLLDFLRNKTWYSSSMNYEASKQLTDARFKRLVGVQRTTFEEMLAVLKTAYQKSRTSW

SEQ ID NO: 3179 - protein, 223 aa, Streptococcus pneumoniae
  misc_feature (B) LOCATION 1...223
  hypothetical: YES
MMDYPYATCCSLNDEVAHAFPRHYILKDGDLLKVDMVLGRSIAKSDLNVSKLNFNNVEQMKKYTQSYSGGLADSCWAYAVGTPSEEVKNLMDVTKEAMYKGIEQAVVGNRIGDIGAAIQEYAESRGYGVVRDLVGHGVGPTMHEEPMVPNYGIAGRGLRLREGMVLTIEPMINTGDWEIDTDMKTGWAHKTIDGGLSCQYEHQFVITKDGPVILTSQGEEGTY

SEQ ID NO: 3180 - protein, 443 aa, Streptococcus pneumoniae
  misc_feature (B) LOCATION 1...443
  hypothetical: YES
MKRYLQFWLVNLSVSLILIAGMALTWISKGIGLFLLALSLGQGGYWLFCLWKWEVAFETLHQPLLTNSEYFLEKGQEDLKSLAQYVSALKTKVSQQDQQYKDLPETMEVLLSHLTMGTFLVSAQGQMLLSSRSLPHYFPDVDGDISSLDDLKRMDIRNLVHQAFDQKTRLKQKVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 3181 - protein, 168 aa, Streptococcus pneumoniae
  misc_feature (B) LOCATION 1...168
  hypothetical: YES
NFGYNITTCSSSYSLGDWVVIGVVARENAAEQIKQYQKFTVNISDETSMLAMEQAGFISHQEKLERLGVHYEISERTQISILDACPLVLDCRVDRIVEEDGICHIFAKILERLVAPEFLDEKGHFKNQLFAPTYFMGDGYQRVYRYLDKRVDMKGSFIKKARKKDGKN

SEQ ID NO: 3182 - protein, 599 aa, Streptococcus pneumoniae
  misc_feature (B) LOCATION 1...599
  hypothetical: YES
ANLYLKGILKKGDMLMKIYKKLFAYVQDKKYLGVLAIIFSAISAALTVYGYYLIYKFLDKLIINSNLSGAESIALKSVITLTSGAIFYFVSGMFSHILGFRLETNLRKRGIDGLEKASFRFFDLNPSGQIRKIIDDNAAQTHQVVAHMIPDSSQAIITPVLVLALGFIVSIRVGIILLALTIIGGLILGAMMGEQEFMKIYQESLSKLSAETVEYVRGMQVVKIFKANVESFKSFYKAIKDYSKYAYDYSLSCKRPYVLYQWLFFGLIAILIIPIVYFMTSLASAKVILLELIMILFLSGVLFVSFMRMMWYSMYISQGNYAVDTLEALYEDMQKDKLVHGNVNNFKNYNIEFENVSFAYNDKAVIENLSFNLEEGKSYALVGSSGSGKSTVAKLISGFYNVNKGSIKIGGIAISEYSDEALIKAISFVFQDSKLFKKSIYDNVALANKDATKDDVMRALKLAGCDLILDKFPERENTIIGSKGVYLSGGEKQRIAIARAILKDSKIIIMDEASASIDPDNEFELQKAFKNLMKDKTVIMIAHRLSTIKDLDEIIVMDSGKIIERGSDKELMSKDTRYKSLQEMFNIANEWRVSNERVL

SEQ ID NO: 3183 - protein, 298 aa, Streptococcus pneumoniae
  misc_feature (B) LOCATION 1...298
  hypothetical: YES
RLSLKYGMIKDIQGDKMNNNLLVLQSDFGLVDGAVSAMIGVALEESPTLKIHHLTHDITPYNIFEGSYRLFQTVDYWPEGTTFVSVVDPGVGSKRKSVVAKTAKNQYIVTPDNGTLSFIKKHVGIVAIREISEVANRRQNTEHSYTFHGRDVYAYTGAKLASGHITFEEVGPELSVEQIVELPVVATIIEDHLVKGAIDILDVRFGSLWTSITREEFYKLEPEFGDRFEVTIYHADMLVYQNQVVYGKSFADVRIGQPILYINSLYRLGLAINQGSFAKAYNVGVGSSWTIEIKKIEG

SEQ ID NO: 3184 - protein, 70 aa, Streptococcus pneumoniae
  misc_feature (B) LOCATION 1...70
  hypothetical: YES
RLLYQEKITYHVKDNQLEVETDKYTYTAARNGSKEVGIQESDIAATLSADEYNSNRQTFEREYKYKSKCP

SEQ ID NO: 3185 - protein, 64 aa, Streptococcus pneumoniae
  misc_feature (B) LOCATION 1...64
  hypothetical: YES
YSLYYINNQLRRNLVRIHASTHKELLKKFTVFIIIFEEKNSEKKKKACSVSYRFLADGLFSRLC

SEQ ID NO: 3186 - protein, 601 aa, Streptococcus pneumoniae
  misc_feature (B) LOCATION 1...601
  hypothetical: YES
SILYKVNYDNMEVLCMVDKQVIEEIKNNANIVEVIGDVISLQKAGRNYLGLCPFHGEKTPSFNVVEDKQFYHCFGCGRSGDVFKFIEEYQGVTFMEAVQILGQRVGIEVEKPLYSEQKPASPHQALYDMHEDAAKFYHAILMTTTMGEEARNYLYQRGLTDEVLKHFWIGLAPPERNYLYQRLSDQYREEDLLDSGLFYLSDANQFVDTFHNRIMFPLTNDQGKVIAFSGRIWQKTDSQTSKYKNSRSTAIFNKSYELYHMDRAKKSSGKASEIYLMEGFMDVIAAYRVGIENAVASMGTALSREHVEHLKRLTKKLVLVYDGDKAGQAAILKALDEIGDMPVQIVSMPDNLDPDEYLQKNGPEDLAYLLTKTRISPIEFYIHQYKPENSENLQAQIEFIEKIAPLIVKEKSIAAQNSYIHILADSLASFDYAQIEQIVNESRQVQRQNRMERISRPTPITMPVTKQLSAIMRAEAHLLYRMMESPLVLNDYRLREDFAFATPEFQVLYDLLGQYGNLPPEVLAEQTEEVERAWYQVLAQDLPAEISPQELSEVEMTRNKALLNQDNMRIKKKVQEASHVGDTDTALEELERLISQKRRME

SEQ ID NO: 3187 - protein, 65 aa, Streptococcus pneumoniae
  misc_feature (B) LOCATION 1...65
  hypothetical: YES
LCIYFVILFSLIVSNALVASSKITILGLFINARASAIRCLCPPEIFDPISEMIVLNFIGIAMISS

SEQ ID NO: 3188 - protein, 157 aa, Streptococcus pneumoniae
  misc_feature (B) LOCATION 1...157
  hypothetical: YES
RSSLNSQFAHIFRATSYFSDWIWTCGHNFTKKFSQDSPKMKMGTYIVVGTIVLLVVLGYVGLASYIQEGAFYIPAPWDSLSVFTISLVIGIWSWKEAVFRPFVSMIIAHLVVGSLLRYYEWMGISNVFLTKVIPLAVLFIGIFVLFRGFKKIKWSEV

SEQ ID NO: 3189 - protein, 82 aa, Streptococcus pneumoniae
  misc_feature (B) LOCATION 1...82
  hypothetical: YES
KVIYYMDTKMMSQFSVMDNEMLVRTEDGDVSDIYRGYANQRSPFASYPSILKNSGPFPVSGYCLRGYHDRGYIGAGFHLCGI

SEQ ID NO: 3190 - protein, 862 aa, Streptococcus pneumoniae
  misc_feature (B) LOCATION 1...862
  hypothetical: YES
DTVYSFSFXHISNSFKNGIIVTSQNWRETMSFYNHKEIEPKWQGYXAEHHTXKTGTDASKPKFYALDMFPYPSGAGLHVGHPEGYTATDILSRYKRAQGYNVLHPMGWDAFGLPAEQYAMDTGNDPAEFTAENIANFKRQINALGFSYDWDREVNTTDPNYYKWTQWIFTKLYEKGLAYEAEVPVNWVEELGTAIANEEVLPDGTSERGGYPVVRKPMRQWMLKITAYAERLLNDLDELDWSESIKDMQRNWIGKSTGANVTFKVKGTDKEFTVFTTRPDTLFGATFTVLAPEHELVDAITSSEQAEAVADYKHQASLKSDLARTDLAKEKTGVWTGAYAINPVNGKEMPIWIADYVLASYGTGAVMAVPAHDQRDWEFAKQFDLPIVEVLEGGDVKEAAYTEDGLHVNSDFLDELNKEDAIAKIVAWLEEKGCGQEKVTYRLRDWLFSRQRYWGEPIPIIHWEDGTSTAVPETELPLVLPVTKDIRPSGTGESPLANLTDWLEVTREDGVKGRRETNTMPQWAGSSWYYLRYIDPHNTEKLADEDLLKQWLPVDIYVGGAEHAVLHLLYARFWHKFLYDLGVVPTKEPFQKLFNQGMILGTSYRDHRGALVATDKVEKRDGSFFHIETGEELEQAPAKMSKSLKNVVNPDDVVEQYGADTLRVYEMFMGPLDASIAWSEEGLEGSRKFLDRVYRLITSKEILAENNGALDKAYNETVKAVTEQIESLKFNTAIAQLMVFVNAANKEDKLYVDYAKGFIQLIAPFAPHLAEELWQTVAETGESISYVAWPTWDESKLVEDEIEIVVQIKGKVRAKLMVAKDLSREELQEIALADEKVKAEIDGKEIVKVISVPNKLVNIVVK

SEQ ID NO: 3191 - protein, 403 aa, Streptococcus pneumoniae
  misc_feature (B) LOCATION 1...403
  hypothetical: YES
PSSLVFLWYNRAMKHFDTIVIGGGPAGMMATISSNFYGQKTLLIEKNRKLGKKLAGTGGGRCNVTNNGSLDNLLAGIPGNGRFLYSVFSQFDNHDIINFFTENGVKLKVEDHGRVFPASDKSRTIIEALEKKITELGGQVATQIEIVSVKKVDDQFVLKSADQTFTCEKLIVTTGGKSYPSTGSTGFGHEIARHFKHTITDLEAAESPLLTDFPHKALQGISLDDVTLSYGKHVITHDLLFTHFGLSGPAALRMSSFVKGGEVLSLDVLPQLSEKDLVTFLEENREKSLKNALKTLLPERLAEFFVQGYPEKVKQLTEKEREQLVQSIKELKIPVTGKMSLAKSFVTKGGVSLKEINPKTLESKLVPGLHFAGEVMDINAHTGGFNITSALCTGWVAGSLHYD

SEQ ID NO: 3192 - protein, 154 aa, Streptococcus pneumoniae
  misc_feature (B) LOCATION 1...154
  hypothetical: YES
KKSLNKEDTIMDIWEKMYEEAQKLYNPHEVSDFVYANHVVAAVEAEDGQIFTGFCMEGTCGVFHLCAERAALFNMYQFSGQTKVKKVLAFRDKPPYGGSSAMPCGACREFLLELNAENKDAEFMMDYNIRKTVKVAELIPYWWGEERASKFNER

SEQ ID NO: 3193 - protein, 146 aa, Streptococcus pneumoniae
  misc_feature (B) LOCATION 1...146
  hypothetical: YES
LISYHCYIMLXDXSLVLVSRLKTLENLLRSLTGVSNPTTDSARLVLAEAKKAFADDSLTEQGLRDILQTVKDAIASLESIKESQSATKDGGQTAGKETADKDVLENSQEELQKAVLFLADEKGSEHTEAELIDNLKEVIAKLKANA

SEQ ID NO: 3194 - protein, 99 aa, Streptococcus pneumoniae
  misc_feature (B) LOCATION 1...99
  hypothetical: YES
SCSYLISIYYSTKLEKEKIMTKTILVTGGTSYIGSHTVKALLNAGYQVHVLDNLSTGNRAAVDSRASFKELDVYDASALKAYLKKNQIDAVFPFPVEIF

SEQ ID NO: 3195 - protein, 104 aa, Streptococcus pneumoniae
  misc_feature (B) LOCATION 1...104
  hypothetical: YES
NASYQARKFHEVNYSQKAEQQAKTPKKGGKKQAPASNVPKWSNPDYVNELDPKIVDMLVEFHKSQGTLETPEAQAEIAQKREEIEQRRAELEGKKQELLNRLNK

SEQ ID NO: 3196 - protein, 899 aa, Streptococcus pneumoniae
  misc_feature (B) LOCATION 1...899
  hypothetical: YES
FMSLQKLENYSNKSVVQEEVLILTELLEDITKNMLAPETFEKIIQLKELSTQEDYQGLNRLVTSLSNDEMVYISRYFSILPLLINISEDVDLAYEINHQNNIDQDYLGKLSTTIKLVAEKENAVEILEHLNVVPVLTAHPTQVQRKSMLDLTNHIHSLLRKYRDVKLGLINKDKWYNDLRRYIEIIMQTDMIREKKLKVTNEITNAMEYYNSSFLKAVPHLTTEYKRLAQAHGLNLKQAKPITMGMWIGGDRDGNPFVTAKTLKQSALTQCEVIMNYYDKKIYQLYREFSLSTSIVNVSKQVREMARQSKDNSIYREKELYRRALFDIQSKIQATKTYLIEDEEVGTRYETANDFYKDLIAIRDSLLENKGESLISGDFVELLQAVEIFGFYLASIDMRQDSSVYEACVAELLKSAGIHSRYSELSEEEKCDLLLKELEEDPRILSATHAEKSELLAKELAIFKTARVLKDKLGDDVIRQTIISHATSLSDMLELAILLKEVGLVDTERARVQIVPLFETIEDLDHSEETMRKYLSLSLAKKWIDSRNNYQEIMLGYSDSNKDGGYLSSCWTLYKAQQQLTAIGDEFGVKVTFFHGRGGTVGRGGGPTYEAITSQPLKSIKDRIRLTEQGEVIGNKYGNKDAAYYNLEMLVSAAINRMITQKKSDTNTPNRYEAIMDQVVDRSYDVYRDLVFGNEHFYDYVFESSPIKAISSFNIGSRPAARKTITEIGGLRAIPWVFSWSQSRVMFPGWYGVGSSFKEFINKNPENIAILRDMYQNWPFFQSLLSNVDMVLSKSNMNIAFEYAKLCEDEQVKAIYETILNEWQVTKNVILAIEGHDELLADNPYLKASLDYRMPYFNILNYIQLELIKRQRRGELSSDQERLIHITINGIATGLRNSG

SEQ ID NO: 3197 - protein, 481 aa, Streptococcus pneumoniae
  misc_feature (B) LOCATION 1...481
  hypothetical: YES
KMTYEVKSLNEECGVFGIWGHPDAAKLTYFGLHSLQHRGQEGAGILSNDQGQLKRHRDMGLLSEVFRNPANLDKLTGAGAIGHVRYATAGEASVDNIQPFLFRFHDMQFGLAHNGNLTNAASLKKELEQRGAIFSATSDSEILAHLIRRSHNPSLMGKIKEALSLVKGGFAYILLFENKLIAALDPNGFRPLSIGKMANGAVVVSSETCAFEVIGAEWIRDLKPGEIVIIDDEGIQYDSYTDDTQLAICSMEYIYFARPDSNIHGVNVHTARKRMGAQLAREFKHEADIVVGVPNSSLSAAMGFAEESGLPNEMGLIKNQYTQRTFIQPTQELREQGVRMKLSAVSGVVKGKRVVMVDDSIVRGTTSRRIVQLLKEAGATEVHVAIGSPALAYPCFYGIDIQTRQELIAANHTVEETRQIIGADSLTYLSIDSLIESIGIETDAPNGGLCVAYFDGDYPTPLYDYEEDYRRSLEEKTSFYK

SEQ ID NO: 3198 - protein, 63 aa, Streptococcus pneumoniae
  misc_feature (B) LOCATION 1...63
  hypothetical: YES
AWTYPKGNNFTTVFLRALFGDQQLIRIMLWFLVLLLLVLNVEDFELFERVDLTGDLSRAQGDD

SEQ ID NO: 3199 - protein, 408 aa, Streptococcus pneumoniae
  misc_feature (B) LOCATION 1...408
  hypothetical: YES
SMAYQEPNKDGFYGKFGGRFVPETLMTAVLELEKAYRESQADPSFQEELNQLLRQYVGRETPLYYAKNLTQHIGGAKIYLKREDLNHTGAHKINNALGQVWLAKRMGKKKIIAETGAGQHGVATATAAALFNMECTIYMGEEDVKRQALNVFRMELLGAKVEAVTDGSRVLKDAVNAALRSWVANIDDTHYILGSALGPHPFPEIVRDFQSVIGREAKQQYRDLTGQNLPDALVACVGGGSNAIGLFHPFVEDESVAMYGAEAAGLGVDTEHHAATLTKGRPGVLHGSLMDVLQDAHGQILEAFSISAGLDYPGIGPEHSHYHDIKRASYVPVTDEEALEGFQLLSRVEGIIPALESSHAIAFAVKLAKELGPEKSMIVCLSGRGDKDVVQVKDRLEADAAKKGEAHA

SEQ ID NO: 3200 - protein, 96 aa, Streptococcus pneumoniae
  misc_feature (B) LOCATION 1...96
  hypothetical: YES
IAKYEILYIIRPNIEEEAKNALVARFDSILTDNGATVVESKTWEKRRLAYEIQDFREGLYHIVNVEANDDAALKEFDRLSKINADILRHMIVKIDA

SEQ ID NO: 3201 - protein, 367 aa, Streptococcus pneumoniae
  misc_feature (B) LOCATION 1...367
  hypothetical: YES
QIKYAEGYPGRRYYGGTDVVDVVETLAIERAKEIFGAKFANVQPHSGSQANCAAYMSLIEPGDTVMGMDLAAGGHLTHGAPVSFSGQTYNFLSYSVDPETELLDFDAILKQAQEVKPKLIVAGASAYSQIIDFSKFREIADAVGAKLMVDMAHIAGLVAAGLHPSPVPYAHITTTTTHKTLRGPRGGLILTNDEDLAKKINSAIFPGIQGGPLEHVVAAKAVSFKEVLDPAFKEYAANVIKNSKAMADVFLQDPDFRIISGGTENHLFLVDVTKVVENGKVAQNLLDEVNITLNKNSIPYETLSPFKTSGIRIGAAAITARGFGEEESRKVAELIIKTLKNSENEAVLEEVRSAVKELTDAFPLYEE

SEQ ID NO: 3202 - protein, 74 aa, Streptococcus pneumoniae
  misc_feature (B) LOCATION 1...74
  hypothetical: YES
SKKYAIMLKKYFSKYKWTDLFWILFVILTCLYIGNHDLFTLNHQEFSFRGSVWGLVLALYHLLFIDKFVISNRK

SEQ ID NO: 3203 - protein, 487 aa, Streptococcus pneumoniae
  misc_feature (B) LOCATION 1...487
  hypothetical: YES
VEKYLVQSPHRNQDLDLAYLRSGIADLGHLSYPEQLKFKTKQVKDSLYKIAGIADVEVAETLGMEHPVKYRNKAQVPVRRVNGVLETGFFRKNSHDLMPLEDFFIQDPVIDQVVVALRDLLRRFDLKPYDEKEQSGLIRNLVVRRGHYSGQIMVVLVTTRPKVFRVDQLIEQVIKQFPEIVSVMQNINDQNTNAIFGKEWRTLYGQDYITDQMLGNDFQIAGPAFYQVNTEMAEKLYQTAIDFAELKKDDVIIDAYSGIGTIGLSVAKHVKEVYGVELIPEAVENSKKNAQLNNISNAHYVCDTAENAMKNWLKDGIQPTVILVDPPRKGLTESFIKASAQTGADRIAYISCNVATMARDIKLYQELGYELKKVQPVDLFPQTHHVETVALLSKLDVDKHISVEIELDEMNLTSAESKATYAQIKEYVWNKFELKVSTLYIAQIKKKCGIELREHYNKSKKDKQIIPQCTPEKEEAIMDALRHFKMI

SEQ ID NO: 3204 - protein, 413 aa, Streptococcus pneumoniae
  misc_feature (B) LOCATION 1...413
  hypothetical: YES
GGKYMSSHPIQVFSEIGKLKKVMLHRPGKELENLLPDYLERLLFDDIPFLEDAQKEHDAFAQALRDEGIEVLYLEQLAAESLTSPEIRDQFIEEYLDEANIRDRQTKVAIRELLHGIKDNQELVEKTMAGIQKVELPEIPDEAKDLTDLVESEYPFAIDPMPNLYFTRDPFATIGNAVSLNHMFADTRNRETLYGKYIFKYHPIYGGKVDLVYNREEDTRIEGGDELILSKDVLAVGISQRTDAASIEKLLVNIFKKNVGFKKVLAFEFANNRKFMHLDTVFTMVDYDKFTIHPEIEGDLHVYSVTYENEKLKIVEEKGDLAELLAQNLGVEKVHLIRCGGGNIVAAAREQWNDGSNTLTIAPGVVVVYDRNTVTNKILEEYGLRLIKIRGSELVRGRGGPRCMSMPFEREEV

SEQ ID NO: 3205 - protein, 78 aa, Streptococcus pneumoniae
  misc_feature (B) LOCATION 1...78
  hypothetical: YES
WRKYIMILMTKNINLTNEELELIQGGADPYGKNPNGRYDWEIEPVLTLPVHGFCPRGTYDLGYIGGGNHLCKGSAARF

SEQ ID NO: 3206 - protein, 63 aa, Streptococcus pneumoniae
  misc_feature (B) LOCATION 1...63
  hypothetical: YES
QSEYYVRFRVLHAPTKIWVASLRGLPRSTLSVSRKTPSLWHFQAYSGLSKDLAISTAVTIPRP

SEQ ID NO: 3207 - protein, 123 aa, Streptococcus pneumoniae
  misc_feature (B) LOCATION 1...123
  hypothetical: YES
IMEYKLFEEFITLQALLKELGITHSGGAIKSFLSEHSVYFNRELESRRGKKLRIGDKVDIPDMNIDILLTQPTSEEQDEYQADKVEKERIAKLVKKMNKGVKKDKSKPASSPKSQQAPRFPGR

SEQ ID NO: 3208 - protein, 664 aa, Streptococcus pneumoniae
  misc_feature (B) LOCATION 1...664
  hypothetical: YES
LCRYLRRIHGRTSYPDLHLSRRCQSLRCPCQLATGGKAMVRFTGLSPKQTQAIEVLKGHISLPDVEVAVTQSDQASISIEGEEGHYQLTYRKPHQLYRALSLLVTVLAEADKVEIEEQAAYEDLAYMVDCSRNAVLNVASAKQMIEILALMGYSTFELYMEDTYQIEGQPYFGYFRGAYSAEELQEIEAYVQQFDMTFVPCIQTLAHLSAFVKWGVKEVQELRDVEDILLIGEEKVYDLIDGMFATLSKLKTRKVNIGMDEAHLVGLGRYLILNGVVDRSLLMCQHLERVLDIADKYGFHCQMWSDMFFKLMSADGQYDRDVEIPEETRVYLDRLKDRVTLVYWDYYRDSEEKYNRNFRNHHKISHDLAFAGGAWKWIGFTPHNHFSRLVAIEANKACRANQIKEVIVTGWGDNGGETAQFSILSSLQIWAELSYRNDLDSLSAHFKTNTGLTVEDFMQIDLANLLPDLPGNLSGINPNRYVFYQDVLCPILDRHMTPEQDKPHFAQAAETLANIKEKAGNYAYLFETQAQLNAILSSKVDVGRRIRQAYQEDDKESLQQIARQELPELRSQIEDFHALFSHQWLKENKVFGLDTVDIRMGGLLQRIKRAESRIEVYLAGQLDRIDELEVEILPFTDFYADKDFAATTANQWHTIATASTIYTT

SEQ ID NO: 3209 - protein, 97 aa, Streptococcus pneumoniae
  misc_feature (B) LOCATION 1...97
  hypothetical: YES
GCRYDSHIYDKATLTWFEEIFEEYHSPSKASLIWSKKPFFFGFTFKPPAAANSFKATFWRSFKPVGVTTLTVTYWSPTAPPRRLGAPLLRRRNFLPV

SEQ ID NO: 3210 - protein, 565 aa, Streptococcus pneumoniae
  misc_feature (B) LOCATION 1...565
  hypothetical: YES
RRRYITMKKIKPHGPLPSQTQLAYLGDELAAFIHFGPNTFYDQEWGTGQEDPERFNPSQLDAREWVRVLKETGFKKLILVVKHHDGFVLYPTAHTDYSVKVSPWRRGKGDLLLEVSQAATEFDMDMGVYLSPWDAHSPLYHVDREADYNAYYLAQLKEILSNPNYGNAGKFAEVWMDGARGEGAQKVNYEFEKWFETIRDLQGACLIFSTEGTSIRWIGNERGYAGDPLWQKVNPDKLGTEAELNYLQHGDPSGTIFSIGEADVSIRPGWFYHEDQDPKSLEELVEIYFHSVGRGTPLLLNIPPNQAGLFDAKDIERLYEFATYRNELYKEDLALGAEVSGPALSADFACRHLTDGLETSSWANDAALPIQLELDLGSPKTFDVIELREDLKLGQRIAAFHVQVEVDGVWQEFGSGHTVGYKRLLRGAVVEAQKIRVVITESQVLPLLTKISLYKTPRLSQTVAVQGLAFAEKSLAVAKGETLHFRIERSESSSSLEAKISIQPGTGVHGVAYQDEIQVLQFQAGESKKDLHLPTLYFAGDKTLDFYLNLTVDGQLVDQLQVQVS

SEQ ID NO: 3211 - protein, 156 aa, Streptococcus pneumoniae
  misc_feature (B) LOCATION 1...156
  hypothetical: YES
GVTLMDDILQALAKMLNMTVDEVSSLLTTFKGNAPQIYEMFVKEKMFYDLFSLFQIMSIVIFSISAVVLAVLTLIYFTYDGGFVYSYDIRTGKTEEEIKLERIERKRKDLKIPLKISCISSSASLITLVIAIVLKATLAPNYIFIVNEILPKLTKR

SEQ ID NO: 3212 - protein, 97 aa, Streptococcus pneumoniae
  misc_feature (B) LOCATION 1...97
  hypothetical: YES
ITTLLLNSLELTVVSIVVLLALRSVIAELILSKKLDVSVKKDIVLEFLLTIVFISSSWYLPIWPAVIVYLLAYTLYLYLKRKDIKMYIEYFRKKIFE

SEQ ID NO: 3213 - protein, 60 aa, Streptococcus pneumoniae
  misc_feature (B) LOCATION 1...60
  hypothetical: YES
INTLRKSLQTVSVLSATSKRCFEQPVASFLVCSLIFIEYKLSKETSFSEKQGSFCCLFHP

SEQ ID NO: 3214 - protein, 71 aa, Streptococcus pneumoniae
  misc_feature (B) LOCATION 1...71
  hypothetical: YES
TNTLRKSLQTTSASPCRISATSKQCFELTSSVLSTTSKRCFEQPVASFLVCSLIFIEYKELGNRLFLYCVY

SEQ ID NO: 3215 - protein, 427 aa, Streptococcus pneumoniae
  misc_feature (B) LOCATION 1...427
  hypothetical: YES
WITLQNQKYLRNYYIKMDFSRKDNQSMEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKGGVLERNGHTEATVDLLKLAGLKECGLCCEIMNHDGKMMRTDDLIQFSKKHNIPLITIKELQEYRKVYDQLIERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLREYHIGAQMLKDLGLQSLHLLTNNPDKVEQLEKYGITISSRISIEIEANPYDSFYLETKKNRMGHILNMEEK

SEQ ID NO: 3216 - protein, 1217 aa, Streptococcus pneumoniae
  misc_feature (B) LOCATION 1...1217
  hypothetical: YES
MATLDELKVMIDAEIAPFRKKMKEVENQVKGTSDQVKNATAKVREQSSSIGSAFGKLAKFAGFAILGKKLLDVGMYSTQTALEVSASMNQIKRQMGESSQSFLKWVNDNANAMNMGVGEATNYGAVYSNLFSGFIKDTNKLSAYTAKMLQTSAVVAEGSGRTITDVMERIRSGLLGNTEAIEDLGINVNVAMIESTEAFKKFANGQSWQQLDYQTQQQIRLMAILEQATAKYGDTLSNSVNGRISLFKSLMKDAALNLGNSMLPIINAIMPVLNSFAMVLKNVTAKLAEFIALMFNKKATVKDGVGGAVGDMGNAMKDAAGGAGDLADAVDDAGDSAGGLADNLGDSAKNAKKAAKELLGLLGFDEINILQKPKDDDAGGSGGGGKGGKGKGGGGGPFKDILPEVELTDMDNKFKSIFDGLGDKLKGLFDLFKKGFDAAFRPEGIERIKTALDQIAKTMGEIATDPRVVNAFNRMAEKIAYALGQVTGSITTIGLGIGVFLAESIANGLGRQKERITRALVALFDNIGNISEAVGNIAQDFSSTFYDVITSTGAVRIGSAIVSTLLSLTSTIVEVGSKLAGSLFKGFEKVVVTSAPKISSVFQSLLDTVAPVFESIERSVNKFGDGLSRVYDEHVAPAINSIANAFNGLIDIIQILWENSWQPFAEFLSGVFGVSIEGISDLLGGGLLATLGLLADAIKLVADGFTVFSDWCKENKEPILALITTWQTINFLSWAEQAGGLAGAFSLLGSKVSLIVGGIKNLGLAIKALTFDKLVSFGETIYLNTLYAKDFVVNSGKTIAQLGKTALELGKSALAWTAHAAKMGLATAAEFAHSVAAGVATAATWAFNAALAVLTSPITWIIAAIAALIAIGVLLYQNWDTVVEFAKTAWQGLCDFISGICRAIGEFFSGLWTKLQEIFEPIGQWFGEKFQQAWDAIVNIFSGIGEWFSGVFQGAWDAIVNIFTPIGSWFGQRWADVTSALANIGAWFTDIFQKAWTGLTNIFSKLGLWFGERWADVTSVLANVSSWFGNMFTSAYNAVKNAFSSIGGFFSGVWSTVQSIFVNAGQKVGSAVGGAFKSAVNAVLGTIENVVNDFIGMINGVLGVVRNLPGLGWVGSVSTVSLPRLARGGIVDSPTIAMIGEAGKEAVVPLENTGFIQTLGRVVSSAVVNAMAGISPQGGFSSDGDIVIQIAGHEFGRVAIQEINKEHERAGQTLLKI

SEQ ID NO: 3217 - protein, 486 aa, Streptococcus pneumoniae
  misc_feature (B) LOCATION 1...486
  hypothetical: YES
NILYGDKGCVENSLENLHAIGNGFKLSYLHEIDACKVPDWVSNTVWYQIFPERFANGNALLNPEGTLDWDSSVTPKSDDFFGGDLQGIIDHMDYLHDLGITGLYLCPIFESTSNHKYNTTDYFEIDRHFGDKETFRELVDQAHHRGMKVMLDAVFNHIGSQSLQWKNVVKNGEQSAYKDWFHIQQFPVTTEKLVNKRDLPYHVFGFEDYMPKLNTANPEVKNYLLKVATYWIEEFNIDAWRLDVANEIDHQFWKDFRKAVLAKNPDLYILGEVWHTSQPWLNGDEFHAVMNYPLSDSIKDYFLRGIKKTDQFIDEINGESMYYKQQISEVMFNLLDSHDTERILWTANEDVQLVKSALAFLFLQKGTPCIYYGTELALTGGPDPDCRRCMPWERVSSDNDMLNFMKRLIKIRKYASVIISHGKYSLQEIKSDLVALEWKYEGRILKAIFNQSTEDYLLEKEAVALASNCQELENQLVISPDGFVIF

SEQ ID NO: 3218 - protein, 418 aa, Streptococcus pneumoniae
  misc_feature (B) LOCATION 1...418
  hypothetical: YES
IVLYESIRLVYMKRSLDSRVDYSLLLPVFFLLVIGVVAIYIAVSHDYPNNILPILGQQVAWIALGLVIGFVVMLFNTEFLWKVTPFLYILGLGLMILPIVFYNPSLVASTGAKNWVSINGITLFQPSEFMKISYILMLARVIVQFTKKHKEWRRTVPLDFLLIFWMILFTIPVLVLLALQSDLGTALVFVAIFSGIVLLSGVSWKIIIPVFVTAVTGVAGFLAIFISKDGRAFLHQIGMPTYQINRILAWLNPFEFAQTTTYQQAQGQIAIGSGGLFGQGFNASNLLIPVRESDMIFTVIAEDFGFIGSVLVIALYLMLIYRMLKITLKSNNQFYTYISTGLIMMLLFHIFENIGAVTGLLPLTGIPLPFISQGGSAIISNLIGVGLLLSMSYQTNLAEEKSGKVPFKRKKVVLKQIK

SEQ ID NO: 3219 - protein, 191 aa, Streptococcus pneumoniae
  misc_feature (B) LOCATION 1...191
  hypothetical: YES
NALYQVLGADIMRFSAFKIFSNSVCKRIITKGLGFRALLLYTISKVKLREDILVSQSIVPVEIPQYCRFDSKKRNGILFNVRIANLKFTFFRLDFLRNKIWYSSSMNDEASKQLTDARFKRLVGVQRTTFEEMLAVLKTAYQLKHAKGGRKPKLSLEDLLMATLQYVREYRTYEEIAAVFGIHESNLIRRS

SEQ ID NO: 3220 - protein, 123 aa, Streptococcus pneumoniae
  misc_feature (B) LOCATION 1...123
  hypothetical: YES
MNMYRVIEMYGDFEPWWFLEGWEEDIVASRKFDQYYDALKYYKTCWFRLEQESPLYKSRSDLMTIFWDPEDQRWCDECDEYLQQYHSLALLQDEQVIPDEKLRSGYEKQTSQERNRSCRMKLK

SEQ ID NO: 3221 - protein, 119 aa, Streptococcus pneumoniae
  misc_feature (B) LOCATION 1...119
  hypothetical: YES
EMVYQVFSVLFSSERAYSFSSPVALQKLRKIKMRIRRKLMKKEKKQLRYPGLKAGSIYGTVIFFIIPLIDTLTSENPNFISSLLNTKHIFKTMLGAFFFGVMIHIVDSLRIARAKKDQD

SEQ ID NO: 3222 - protein, 254 aa, Streptococcus pneumoniae
  misc_feature (B) LOCATION 1...254
  hypothetical: YES
QNDLFWSRIMGLTYQMKMKIPFDMADMNGHIKLPDVILLSLQVSGMQSIELGVSDKAILEEYNLVWIIVEYDIEVFRLPRFAEEITIETEALSYNRLFCYRRFTIYNEAEQELIHMMATFVLMDRDSRKVHVVEPEIVAPYQSDFDKKLIRGPKYESLEEPISKDYHVRFYDLDMNGHVNNSKYLDWIFEVMGADFLTHYIPKKINLKYVKEVRPGGVITSAVERTGLESKHEITSDGVINAQAIITWQEIKKA

SEQ ID NO: 3223 - protein, 178 aa, Streptococcus pneumoniae
  misc_feature (B) LOCATION 1...178
  hypothetical: YES
ENDLVTKVETARSLALAVLEDVFVNQAYSNIALNKHLKGSQLSAADKGLVTELVYGTVARKLTLEWYLSHFIEDRDQLDSWLYVLLLMSAYQLRYLDKIPDHAVVNEAVELAKLRKKGSEKLVNAVLRRILREGWPDIASIKRKNKRDSIAYSLPVWLVTKLKEEYGEERAKAIFESL

SEQ ID NO: 3224 - protein, 142 aa, Streptococcus pneumoniae
  misc_feature (B) LOCATION 1...142
  hypothetical: YES
DLSYKSRLPAYGYDWFLTRRQYTQFIGLEYQDQIGCLGVFSSANWLHQEAFNRYIECQKLSPDQRIFIYVGTEEADDTDKTLMDGNIKQAYIDSSLCYYHDLIAGGVHLDNLVLKVQSGAIHSEIPWSENLPDCLRFFAEKW

SEQ ID NO: 3225 - protein, 231 aa, Streptococcus pneumoniae
  misc_feature (B) LOCATION 1...231
  hypothetical: YES
FSDFTMCHLIASIGLNMDSTPVIIGAMLISPLMTPILGVGLSLAIFDFKLLRKSFKILAIQILASLIASTLYFYLSPISYASSEIVARTSPTIWDVLIAFVGGIAGIIGARKKETNNIVPGVAIATALMPPLCTVGYAIASANLKFIIGSSYLFLINCSFIVIATYIGVRLMMVKKHYFKDNEEDSKMRRILLLVAVLLMIPSFISATTLVRETLKKESLKKFISEQVSGA

SEQ ID NO: 3226 - protein, 110 aa, Streptococcus pneumoniae
  misc_feature (B) LOCATION 1...110
  hypothetical: YES
AFQYLTILYFLRNKIWYSSSMNDEASKQLTDARFKRLVGVQRTTFEEMLAVLKTAYQLKHAKGGRKPKLSLEDLLMATLHMCENIELMNKLRLILVFTKATLSVGANGLK

SEQ ID NO: 3227 - protein, 545 aa, Streptococcus pneumoniae
  misc_feature (B) LOCATION 1...545
  hypothetical: YES
KEKYKLSPIGWLRTTFRKKNNVKFNELNLSADLLAEIEKAGFVEASPIQEQTIPLALEGKDVIGQAQTGTGKTAAFGLPTLEKIRTEEATIQALVIAPTRELAVQSQEELFRFGRSKGVKVRSVYGGSSIEKQIKALKSGAHIVVGTPGRLLDLIKRKALKLQDIETLILDEADEMLNMGFLEDIEAIISRVPENRQTLLFSATMPDAIKRIGVQFMKAPEHVKIAAKELTTELVDQYYIRVKEQEKFDTMTRLMDVAQPELAIVFGRTKRRVDELTRGLKIRGFRAEGIHGDLDQNKRLRVLRDFKNGNLDVLVATDVAARGLDISGVTHVYNYDIPQDPESYVHRIGRTGRAGKSGQSITFVAPNEMGYLQIIENLTKKRMKGLKPASVEESFQSKKQVALKKIERDFADETIRANFEKFGKDARKLAAEFTPEELAMYILSLTVQDPDSLPEVEIAREKPLPFKPSGNGFGGKAKGGRGGRRGDDRRERDRRGNGRRDEFKKGSRGNDRFDKEKRYRKDNKKPRNTLSEKQTGFVIRNKGDK

SEQ ID NO: 3228 - protein, 280 aa, Streptococcus pneumoniae
  misc_feature (B) LOCATION 1...280
  hypothetical: YES
YRKYDSRRIINTSFRKKVYEEKQYFIFILLLCIGLQYETIYYTDGSRSGAEYGLMGVSIFLALFYMIPALYFLFRIGKKWELPKKVLILSLLGGMFLAGWLSSFANTYIHDLLGVLFPDSPFLNAFESAIVAPLVEEPLKLLPLVFVLALIPVRKLKFLFLLGIASGLGFQMIEDIGYIRTDLPEGFDFTISRILERIISGIASHWTFSGLAVVGVYLLYRAYKGQKVGKKQGLIFLGLALGTHFLFNSPFCGVGNRVAFSDSSGYGYCSLWFLSCLLLC

SEQ ID NO: 3229 - protein, 291 aa, Streptococcus pneumoniae
  misc_feature (B) LOCATION 1...291
  hypothetical: YES
MKEYDMKKWWKELIDKPLLKAFLHYYQASDSELTSVAVAYYWLISIFPLLLVVVNILPYFQIPVGEFLGFMKDVLPPSLYEGVEKIAREVLTQPSTGLLSFSVLSALWSFSKSMNFLQKAFNKAYGVEKSRGLISHQMLSLLVSFGLQILFAFALFLILFGQMILALLAHYWTKDGIIYQALQGLAGPLIYALLFAILVMLYYFLPNLSNRKISYTLPGSAFVLLVILGLLTLFSSYLNYYVHHLVDVRILGSVLLVVMMFWFILIAKIVILGAVINASMQSLKDPVFKKD

SEQ ID NO: 3230 - protein, 399 aa, Streptococcus pneumoniae
  misc_feature (B) LOCATION 1...399
  hypothetical: YES
KKEYLRNMKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 3231 - protein, 156 aa, Streptococcus pneumoniae
  misc_feature (B) LOCATION 1...156
  hypothetical: YES
INWYKMTRYALLVRGINVGGKNKVVMAELRQELTNLGLEKVESYINSGNIFFTSIDSKAQLVEKLETFFAVHYPFIQSFSLLSLEDFEAELENLPAWWSRDLARKDFLFYTEGLDVDQVIATVESLELKDEVLYFGKLGIFWGKFSEESYSKTAYQ

SEQ ID NO: 3232 - protein, 292 aa, Streptococcus pneumoniae
  misc_feature (B) LOCATION 1...292
  hypothetical: YES
ELWYNKRMNYPKIDLKTIRQESKHFQADTPRLFLLYILPSMLVILSGFLNPLSRIHGTVLEQPFFSILGQILQTYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFVLDLQLLPWYFLNWITFGIASFSLLPYIQCTKIMFYRAVLARKRPKA

SEQ ID NO: 3233 - protein, 376 aa, Streptococcus pneumoniae
  misc_feature (B) LOCATION 1...376
  hypothetical: YES
MLDLIQTRRDLHQIPEIGLEEFKTQAYLLDVIEKLTTGKDFVQIRTWRTGILVYLQGSQPERTIGWRTDIDGLPIVEQTGLPFASQHQGRMHACGHDFHMTIALGCLERALEEQPKNNLLFLFQPAEENEAGGMLMYEDGAFGDWLPNQFYGLHVRPDLKVGQIATNTHTLFAGTCEVKIRFKGKGGHAAFPHEANDALVAASYFVTQVQSVVSRNVNPIEGAVVTFGVFQAGTTNNVITDTAFLHGTIRALTQDMSLLVQKRVKTVAEGVAAAFDMEVEVELKQGGYLPVENNPALARELMDFFDEKDGIELIDIEPAMTGEDFGYLLSKVDGVMFWLGIDSPYALHHPQMSPKEEVLAIGVAAVSSFLKKKAAE

SEQ ID NO: 3234 - protein, 213 aa, Streptococcus pneumoniae
  misc_feature (B) LOCATION 1...213
  hypothetical: YES
LAWYDDRRAGGSNDCKCRTNFWIGQQVMKEKISQVIVVEGRDDTVNLKRYFDVETYETRGSAINDQDIERIQRLHQRHGVIVFTDPDFNGERIRRMIMTAIPTVQHAFLKRDEAVPKSKTKGRSLGIEHASYEDLKTALAQVTEQFEHESQFDISRSDLIRLGFLAGADSRKRREYLGETLRIGYSNGKQLLKRLELFGVTLAEVEEAMKSYE

SEQ ID NO: 3235 - protein, 187 aa, Streptococcus pneumoniae
  misc_feature (B) LOCATION 1...187
  hypothetical: YES
EKRYLMTTFTIHTVESAPAEVKEILETVEKDNNGYIPNLIGLLANAPTVLEAYQIVSSIHRRNSLTPVEREVVQITAAVTNGCAFCVAGHTAFSIKQIQMNDDLIQALRNRTPIETDPKLDTLAKFTLAVINTKGRVGDEALSEFLEAGYTQQNALDVVFGVSLAILCNYANNLANTPINPELQPYA

SEQ ID NO: 3236 - protein, 369 aa, Streptococcus pneumoniae
  misc_feature (B) LOCATION 1...369
  hypothetical: YES
IWRYCMSKELHINTILAQAGIKSDEATGALVTPLHFSTTYQHPEFGRSTGFDYTRTKNPTRSKAEEVLATIESADYALATSSGMSAIVLAFSGFPVGSKVLAVRDLYGGSFRWFNQVEQEGRFHFTYANTEEELIAELEKDVDVLYIETPTNPLMLEFDIEKLAKLAHAKGAKVVVDNTFYSPIYQRPIEDGADIVLHSATKYLAGHNDVLAGVVVTNSLELYEKLFYNLNTTGAVLSPFDSYQLLRGLKTLSLRMERSTANAQEVVAFLKDSPAVKEVLYTGRGGMISFKVADETRIPHILNSLKVFSFAESLGGVESLITYPTTQTHADIPAEVRHSYGLTDDLLRLSIGIEDARDLIADLRQALEG

SEQ ID NO: 3237 - protein, 201 aa, Streptococcus pneumoniae
  misc_feature (B) LOCATION 1...201
  hypothetical: YES
AADLAIGDFEGTINKDHYLAGYLLFNAPVEVMDAIKEAGYHVLDLAHNHILDSQIEGVISTADIIEKAGITPIGVYTHEPRDQAPLVIKEVNAIKVALLAYSYGFNGIEQYIFQEDYNRYLSDLNEDKIKAEVERAEKEADITIIMPQMGVEYRLEPTEEQKALYHKMIDWGADIIFGGHPHVVEPSETVEKDGDKKLIIY

SEQ ID NO: 3238 - protein, 276 aa, Streptococcus pneumoniae
  misc_feature (B) LOCATION 1...276
  hypothetical: YES
AIXYDMNLNMSIXSMVLVVVVAVFAGLEGILDQFQFHQPLVACTLIGLVTGHLEAGIILGGSLQMIALGWSNIGAAIAPDAALASVAAAIIMVLGGDFTKTGIGVAQAVAIPLAVAGLFLTMIVRTISVGLVHTADAAAKKGDFGAVERAHFIALLFQGLRIALPAALLLMVPTETVQSILSAMPDWLKDGMAIGGGMVVAVGYAMVINMMATREVWPFFALGFVLAAVSDITLIGFGAIGVAIALIYLHLSKTGGNGGGGAATSNDPIGDILEDY

SEQ ID NO: 3239 - protein, 260 aa, Streptococcus pneumoniae
  misc_feature (B) LOCATION 1...260
  hypothetical: YES
NQYLLMEKVMSKHPHYELLNLIGYGLAKFDKLFIKEFQCSSKSEFYRYVVSLGIAETTGVVKNRMDLFDPYFDNNRKGWWQKAEVYRFRKDLIDMMFGNEDVHSYAEIVKMLLASEGKKTGITIVEKPIVRTKFKRLQETGMEAENYFILHFDKEEKFQGGQLTDARLYGDGYDFQVDVQEYSYLAEVKGIRKSKGRVRLTAKEFEKVKEFQSDFILSLVTNLDDIPKLVLIDNPLKHFEFKKNIIKNEIIEYRSVEDLY

SEQ ID NO: 3240 - protein, 101 aa, Streptococcus pneumoniae
  misc_feature (B) LOCATION 1...101
  hypothetical: YES
EMYLVIGIVLAFIVSFWKDNRSLWNPVLFLLSLISSYFYLSYLFYKNGYENVQLAFYVFAFVLLPFLLFLSGIFLIYNGVILLKREGRSKPHYLSMLFDFY

SEQ ID NO: 3241 - protein, 290 aa, Streptococcus pneumoniae
  misc_feature (B) LOCATION 1...290
  hypothetical: YES
QMDFTWALKYATEFLGTAILIILGNGAVANVELKGTKGHQSGWIVIAVGYGMGVMIPALMFGNVSGNHINPAFTLGLAVSGLFPWAQVVPYIIAQVLGAIFGQALVVATYRPFYLKTENPNNILGTFSTISSIDHGTKESRYAATVNGLINEFVGSFVLFFAALGLTKNFFGAEVLQFMKQKAIEAGQTVDFSDLAIKAQVAPHTASGLSVAHLALGFLVMALVTSLGGPTGPALNPARDLGPRLLHAFLPKSVLGEHKGDSKWWYSWVPVVAPIAAAIAAVAVFKFLYL

SEQ ID NO: 3242 - protein, 84 aa, Streptococcus pneumoniae
  misc_feature (B) LOCATION 1...84
  hypothetical: YES
KHHLLGQVINLDWFAHIKDKDFPIFGISTSMDNQTTSFWNGHKVTGHAEVCHRYRPTFSNLTFKDWNDTTTATKNIPKTNCTVG

SEQ ID NO: 3243 - protein, 169 aa, Streptococcus pneumoniae
  misc_feature (B) LOCATION 1...169
  hypothetical: YES
FKDFLKGVEDFSTVTKGFFKCWRTNWQDHELLESDWSVRVRTTVDDVHHWSWKNFSVESTKVAVKWDFKVVSSSTSYSDRHTEDCIRTPFTFVRSTVKCDHSTVNSLLITYIVANDSFSNDVVYVVNSFLCTKTTVTRFVTVAKFNCFVFTSRKLLDGTIPRPKAPDSV

SEQ ID NO: 3244 - protein, 263 aa, Streptococcus pneumoniae
  misc_feature (B) LOCATION 1...263
  hypothetical: YES
ANNLERSQVKQMTAIVELKNATKIVKNGFDEEKIILNDVSLEIFERDFITILGGNGAGKSTLFNTIAGTLSLTSGTIRILGEELTKFSPEKRAKYLSRVFQDPKMGTAPRMTVAENLLIAKFRGEKRGLLPRRLTSYKDEFQATIEKVGNGLEKHLNTPIEFLSGGQRQALSLLMATLKRPELLLLDEHTAALDPKTSVALMGLTDEFVKKDQLTALMITHHMEDALKYGNRLIVMKEGRVIQDLKQEEKAKMKISDYYQLFE

SEQ ID NO: 3245 - protein, 93 aa, Streptococcus pneumoniae
  misc_feature (B) LOCATION 1...93
  hypothetical: YES
EVNLMAKKSMVAREAKRQKIVDRYAEKRAALKAAGDYEGLSKLPRNASPTRLHNRCRVTGRPHSVYRKFGLSRIAFRELAHKGQIPGVTKASW

SEQ ID NO: 3246 - protein, 113 aa, Streptococcus pneumoniae
  misc_feature (B) LOCATION 1...113
  hypothetical: YES
FFFHFPPHPPPFPFLPFFPPPNLPPXPPFPSPFFPXPPXTPFFSFFSPPXPSPXLLPPFPPSPFSPPPSXFPLFFXFPFXXXXFFFFXXXXXXIXXPPXXXXXXXXXXXXXIQ

SEQ ID NO: 3247 - protein, 434 aa, Streptococcus pneumoniae
  misc_feature (B) LOCATION 1...434
  hypothetical: YES
VSFHQEERLFKKNKDILNIALPAMGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 3248 - protein, 304 aa, Streptococcus pneumoniae
  misc_feature (B) LOCATION 1...304
  hypothetical: YES
MENLVKSTSDTYILEEIMSFSDLKLFALSSNKELAERVAQEIGIELGKSSVRQFSDGEIQVNIEESIRGKHVFILQSTSSPVNDNLLEILIMVDALKRASAESVNVVMPYYGYARQDRKARAREPITSKLVANMLEVAGVDRLLTIDLHAAQIQGFFDIPVDHLMGAPLIADYFERRGMVGSDYVVVSPDHGGVTRARKLAEFLKTSIAIIDKRRSVDKMNTSEVMNIIGKVEGKTCILIDDMIDTAGTICHAADALAEAGAVEVYASCTHPVLSGPATDNIQKSAIKKVVVLDTIYLPEERSD

SEQ ID NO: 3249 - protein, 215 aa, Streptococcus pneumoniae
  misc_feature (B) LOCATION 1...215
  hypothetical: YES
GLFQSKPFKLYVISVPASLVVILGLILLFFSQEPLHASYLMVVFPVFLLLLVTNIKSQQRGRSARRNRRETPVSLWSRFFKGNLYLLVFEFVYLLSVPFLMKFVLYPVPYQERNRLADLVKEETNTEDAIYAWDDTATLYRKSERLSPSAILSPLHYTATEENRNKLLNDLKEKQPKVIVVNDKVVVWSEVETLLKENYQQVKTDYSEFKVYKIK

SEQ ID NO: 3250 - protein, 643 aa, Streptococcus pneumoniae
  misc_feature (B) LOCATION 1...643
  hypothetical: YES
NRFQTRTKCYIRRFLQMNNQEIAKKVIDALGGRENVNSVAHCATRLRVMVKDEEKINKEVIENLEKVQGAFFNSGQYQIIFGTGTVNKMYDEVVVLGLPTSSKDDMKAEVAKQGNWFQRAIRTFGDVFVPIIPVIVATGLFMGVRGLFNALEMPLPGDFATYTQILTDTAFIILPGLVVWSTFRVFGGNPAVGIVLGMMLVSGSLPNAWAVAQGGEVTAMNFFGFIPVVGLQGSVLPAFIIGVVGAKFEKAVRKVVPDVIDLLVTPFVTLLVMSILGLFVIGPVFHVVENYILIATKAILSIPFGLGGFLIGGVHQLIVVSGVHHIFNLLEVQLLAADHANPFNAIITAAMTAQGAATVAVGVKTKNPKLKTLAFPAALSAFLGITEPAIFGVNLRFRKPFFLSLIAGAIGGGLASILGLAGTGNGITIIPGTMLYVGNGQLPQYLLMVAVSFALGFALTYMFGYEDEVDATAAAKQAEVAEEKEEVAPAALQNETLVTPIVGDVVALADVNDPVFSSGAMGQGIAVKPSQGVVYAPADAEVSIAFPTGHAFGLKTRNGAEVLIHVGIDTVSMNGDGFEAKVAQGNKVKAGDVLGTFDSNKIAAAGLDDTTMVIVTNTADYASVAPVATGSVAKGDAVIEVKI

SEQ ID NO: 3251 - protein, 1972 aa, Streptococcus pneumoniae
  misc_feature (B) LOCATION 1...1972
  hypothetical: YES
ILFQGGIMEKYFGEKQERFSFRKLSVGLVSATISSLFFMSVLASSSVDAQETAGVHYKYVADSELSSEEKKQLVYDIPTYVENDDETYYLVYKLNSQNQLAELPNTGSKNERQALVAGASLAALGILIFAVSKKKVKNKTVLHLVLVAGIGNGVLVSVHALENHLLLNYNTDYELTSGEKLPLPKEISGYTYIGYIKEGKTTSDFEVSNQEKSAATPTKQQKVDYNVTPNFVDHPSTVQAIQEQTPVSSTKPTEVQVVEKPFSTELINPRKEEKQSSDSQEQLAEHKNLETKKEEKISPKEKTGVNTLNPQDEVLSGQLNKPELLYREETIEIKIDFQEEIQENPDLVEGIVRVKQEGKLGKKVEIVRIFSVNKEEVSREIVSTSTTAPIPRIVEKGTKKTQVIKEQPETGVEHKDVQSGAIVEPAIQPELPEAVVSDKGVPEVQPALSKAVITDKGETEVQPESPDTVVSDKGEPEQVAPLPEYKGNIEQVKPETPVEKTKEQGPEKTEEVPVKPTEETPVNPNEGTTEGTSIQEAENPVQPAEESTTNSEKVSPDTSSENTGEESSNPSDSTTSVGESNKPEHNDSKNENSEKTVEEVPVNPNEGTVEGTSNQETEKPVQPAEETQTNSGKIANENTGEVSNKPSDSKPPVEESNQPEKNGTATKPENSGNTTSENGQTEPEKKLELRNVSDIELYSQTNGTYRQHVSLDGIPENTDTYFVKVKSSAFKDVYIPVASITEEKRNGQSVYKITAKAEKLQQELENKYVDNFTFYLDKKAKEENTNFTSFSNLVKAINQNPSGTYHLAASLNANEVELSTDDKSYIKGTFTGQLIGEKDGKHYAIYNLKKPLFENLSGATVEKLSLKNVAISGKNDIGSLANEATNGTKIKQVHVDGVLAGERGVGGLLAKADQSSIAESSFKGRIVNTYETTDSYNIGGLVGHLTGKNASIAKSKATVTISSNTNRSDQTVGGLAGLVDRDAQIQDSYAEGDINNVKHFGRVAGVAGNLWDRTSGDVRHAGSLTNVLSDVNVTNGNAITGYHYTGMKVANTFSSKANRVFNVTLEKDEVVSKESFEERGTMLDASQIVSKKAEISPLTLPTVEPLSTSGKKDSDFSKIAHYQANRALVYKNIEKLLPFYNKSTIVKYGNLVKENSLLYQKELLSAVMMKDDQVITDIVSNKQTANKLLLHYNDHSSEKFDLKYQTDFANLAEYNLGNTGLLYTPNQFLYDRDSIVKEVLPELQKLDYQSDAIRKTLGISPAVKLTELYLEEQFSKTKQNLGGSLKKLLSADAGLASDNSVTRGYLVDKIKNNKEALLLGLTYLERWYNFNYGQVNVKDLVMYHPDFFGKGNTSPLDTLIELGKSGFNNLLAKNNVDTYGISLASHHGTTDLFSALETYRKVFLPNTSNNDWFKKQTKAFIVEEKSTIAEVKAKQKQAGTKYSIGVYDRITSNTWKYRNMVLPLLTLPERSVFVISTLSSLGFGAYDRYRNSEHKAGKDLNNFVEENASETAKRQRDHYDYWYRILDNEGREKLYRTILLYDAYKFGDDTTSGKATVEAKFDSSNPAMKNFFGPVGNKVVHNHHGAYATGDGVYYMSYRMLDKDGAITYTHEMTHDSDQDIYLGGYGRRSGLGPEFFAKGLLQAPDHPYDATITITINSILKHSKSDSLEGSRLQVLDPTERFQNSADLQNYVHNMFDLIYMLEYLEGQSIVKKLNVSQKMEALRKIENQYLTDPADGNEVYATNVVKELTEEEARNLNSFDSLIDNNILSAREYKAGTYERNGYFTIKLFAPIFSALSSEKGTPGDLMGRRIAYELLAAKGFKDGMVPYISNQYEGIAKQNGQTINLYGKKQGLVTDKLVLEKIFSGKYPSWTAFKKAMYQERIAQFDHLTKVIFKDPTKPWPSYGTKTINNVDELQALMDQAVLKDAEGPRWSNYNPEIDSAVHKLKRAIFKAYLDQTNDFRSSIFENKK

SEQ ID NO: 3252 - protein, 293 aa, Streptococcus pneumoniae
  misc_feature (B) LOCATION 1...293
  hypothetical: YES
SHLHMNPDPEALGFQVGLKALLEHQVPQKTIKAVGFDEPTLTWMAEMDLVEDRAYQGALVIVCDTANTARIDDKRYSQGDFLIKIDHHPNDDVYGDLSWVDTSSSSASEMITLFAQTTQLALADRDAELLFAGIVGDTGRFLYPSTTARTLRLAAYLREHNFDFAALTRKMDTMSYKIAKLQGYIYDHLEVDENGAARVILSQKILKQYNVTDAETATIVGAPGRIDRVSLWGIFVEQADGHYRVRLRSKVHPINEIAKEHDGGGHPLASGANSYSLKENEIIYQKLKNLLKN

SEQ ID NO: 3253 - protein, 294 aa, Streptococcus pneumoniae
  misc_feature (B) LOCATION 1...294
  hypothetical: YES
YFIQRKKKTERWEMIMNTHINGISKKGKVLIYGYMLLTILISIFPIAWIFLSSLKADPMKNPGISLPTDFTLEGYINVFTKLHVFTYFWNSFKVVSISVIISIVMISMSSYVIARMEFRGKKLVTSMLYSTLFIPATAMTFPVYRLVNELGIYNTPVALILVYSCSGIAMSFFIIKNYFEIIPKELEEAAEIDGATYAQTFWKVMLPIARPGILTAAVLAFINNWNEYYWASMLVIDKNELTVPALLGQFTTSFNTNYNGLFSAIVVIVLPPIILFAFTSKYFIEALGGGAVKG

SEQ ID NO: 3254 - protein, 244 aa, Streptococcus pneumoniae
  misc_feature (B) LOCATION 1...244
  hypothetical: YES
LKNLRIALISKDWIWKVRKRNKEMTKRIPNLQVALDHSDLQGAIKAAVSVGQEVDIIEAGTVCLLQVGSELAEVLRSLFPDKIIVADTKCADAGGTVAKNNAVRGADWMTCICCATIPTMEAALKAIKTERGERGEIQIELYGDWTFEQAQLWLDAGISQAIYHQSRDALLAGETWGEKDLNKVKKLIDMGFRVSVTGGLDVDTLKLFEGVDIFTFIAGRGITEAADPAGAARAFKDEIKRIWG

SEQ ID NO: 3255 - protein, 61 aa, Streptococcus pneumoniae
  misc_feature (B) LOCATION 1...61
  hypothetical: YES
GCIQLPFLVLNLLKLTDGGTKQRSLLLGVGALLDVSVVVHQLAKPPSLFPRKITDHNRLIL

SEQ ID NO: 3256 - protein, 61 aa, Streptococcus pneumoniae
  misc_feature (B) LOCATION 1...61
  hypothetical: YES
GCIQLPFLVLNLLKLTDAGTKQRSLPLRAGDVLDVSVVVHQLAKPPSLFPGKITDHNKLNL

SEQ ID NO: 3257 - protein, 336 aa, Streptococcus pneumoniae
  misc_feature (B) LOCATION 1...336
  hypothetical: YES
KRVQFELFFCYNEGRKIRQEIDMSEPLFLQSVMQEKIWGGAKLRDEFGYDIPSEKIGEYWAISAHPNGVSKVANGRYEGTDLATLYAEHRELFGNRPEPVFPLLTKILDANDWLSVQVHPDDAYGLEHEGELGKTECWYIIAADEGSEIIYGHNAKSKEELRQQIEDKNWDALLTKVPVKAGDFFYVPSGTMHAIGAGILILETQQSSDTTYRVYDFDRKDDKGNLRELHLEKSIDVLNIGEPANSRPVTIKADDLRSTLLVSNDFFAVYKWEITGKVNFEKTADYSLLSVLAGQGQLTVDGKNYPIQKGRHFILPSDVESWTLEGQDLELIVSHP

SEQ ID NO: 3258 - protein, 126 aa, Streptococcus pneumoniae
  misc_feature (B) LOCATION 1...126
  hypothetical: YES
LLVQSRERNIMANHFRTDRVGMEIKREVNEILQKKVRDPRVQGVTITDVQMLGDLSVAKVYYTILSNLASDNQKAQIGLEKATGTIKRELGRNLKLYKIPDLTFVKDESIEYGNKIDEMLRNLDKN

SEQ ID NO: 3259 - protein, 650 aa, Streptococcus pneumoniae
  misc_feature (B) LOCATION 1...650
  hypothetical: YES
KMSHIIELPEMLANQIAAGEVIERPASVVKELVENAIDAGSSQIIIEIEEAGLKKVQITDNGHGIAHDEVELALRRHATSKIKNQADLFRIRTLGFRGEALPSIASVSVLTLLTAVDGASHGTKLVARGGEVEEVIPATSPVGTKVCVEDLFFNTPARLKYMKSQQAELSHIIDIVNRLGLAHPEISFSLISDGKEMTRTAGTGQLRQAIAGIYGLVSAKKMIEIENSDLDFEISGFVSLPELTRANRNYISLFINGRYIKNFLLNRAILDGFGSKLMVGRFPLAVIHIHIDPYLADVNVHPTKQEVRISKEKELMTLVSEAIANSLKEQTLIPDALENLAKSTVRNREKVEQTILPLKENTLYYEKTEPSRPSQTEVADYQVELTDEGQDLTLFAKETLDRLTKPAKLHFAERKPANYDQLDHPELDLASIDKAYDKLEREEASSFPELEFFGQMHGTYLFAQGRDGLYIIDQHAAQERVKYEEYRESIGNVDQSQQQLLVPYIFEFPADDALRLKERMPLLEEVGVFLAEYGENQFILREHPIWMAEEEIESGIYEMCDMLLLTKEVSIKKYRAELAIMMSCKRSIKANHRIDDHSARQLLYQLSQCDNPYNCPHGRPVLVHFTKSDMEKMFRRIQENHTSLRELGKY

SEQ ID NO: 3260 - protein, 106 aa, Streptococcus pneumoniae
  misc_feature (B) LOCATION 1...106
  hypothetical: YES
DVPQAPKQERNTHMSKLLDKILSRENMLEAYNQVKSNKGSAGIDGMTIEEMDNYLRQNWRLTKELIKQRKYKPQPVLRVEIPKPDGGIRQLGIPTVMDRMIQQAIV

SEQ ID NO: 3261 - protein, 321 aa, Streptococcus pneumoniae
  misc_feature (B) LOCATION 1...321
  hypothetical: YES
NSPHDIIPKFANFVSFYKFYCFCGTIETMASITLTPSEKDIQAFLEHYQTSLAPSKNPYIRYFLKLPQATVSIYTSGKILLQGEGAEKYASFFGYQAVEQTSGQNLPLIGTDEVGNGSYFGGLAVVAAFVTPDQHDFLRKLGVGDSKTLTDQKIRQIAPILKEKIQHQALLLSPSKYNEVIGDRYNAVSVKVALHNQAIYLLLQKGVQPEKIVIDAFTSAKNYDKYLAQEANRFSNPISLEEKAEGKYLSVAVSSVIARDLFLENLENLGRELGYQLPSGAGTASDKVASQILQAYGMQGLNFCAKLHFKNTEKAKKRLER

SEQ ID NO: 3262 - protein, 234 aa, Streptococcus pneumoniae
  misc_feature (B) LOCATION 1...234
  hypothetical: YES
KGTHMSIIEMRDVVKKYDNGTTALRGVSVSVQPGEFAYIVGPSGAGKSTFIRSLYREVKIDKGSLSVAGFNLVKIKKKDIPLLRRSVGVVFQDYKLLPKKTVYENIAYAMEVIGENRRNIKRRVMEVLDLVGLKHKVRSFPNELSGGEQQRIAIARAIVNNPKVLIADEPTGNLDPDNSWEIMNLLERINLQGTTILMATHNSQIVNTLRHRVIAIENGRVVRDESKGEYGYDD

SEQ ID NO: 3263 - protein, 60 aa, Streptococcus pneumoniae
  misc_feature (B) LOCATION 1...60
  hypothetical: YES
NLAHVGYYSKLSFFFFLINVWYAWFLAFWLRAWFGIRRWSCWFLMLWIFRLRSFWFSGGS

SEQ ID NO: 3264 - protein, 574 aa, Streptococcus pneumoniae
  misc_feature (B) LOCATION 1...574
  hypothetical: YES
NPAHTDLLRCFYSFEAKARQSLSLYLHATDELTVEQVDKRTLALRQEGKTETNKNSLTMFTALQMNTDILAISQEAGDWRIDLVSSQTEMQLATSFISPSQALINLPQEDFDSCKASAQADWENLLHRFDVIETGEANRTFFDHCLYRLFLFPQTFYEVDESGQAIHMDLATGTVKPGVLFSNNGFWDTFRTTFPLFALIIPEHYQRFLEGFLNSYRDTGFLPKWLAPDERGMMPGTLLDGIIADSACKDMAPDLEGELFQAMLETASKADPLGINGRHGLAQYQELGYLSTDHHESVSHTLDYAYSDFCIASCAKKLENIEIAETYKAASQNYRQLFDAETGYMRARDNQGNFHPDFSPYSWGRDYAECSAIQATLGVLHDIPGLIQLMGGKETFSNYLLKACQDAPLFETTGYGYEIHEMSEMATAPFGQIAISNQPSFHIPYLFRYSDYPDYTALLIKTLRQKAFHPSWEAYPGDEDNGSLSAWYIWSALGFYPTCPGKPSYDLGIPLFDHLRVYLAKEDKWLDIHTKQNHNHFNFVKECRLDKTLVSTIQHQDLLKAEQLTFTLSWLPSH

SEQ ID NO: 3265 - protein, 72 aa, Streptococcus pneumoniae
  misc_feature (B) LOCATION 1...72
  hypothetical: YES
IGAHFLTKQAGGSGVLPGGVPGVPKGKVTIIGDGVVGTHAARIALGLGAQVTILDISAKRLSVLKEVFGSQI

SEQ ID NO: 3266 - protein, 63 aa, Streptococcus pneumoniae
  misc_feature (B) LOCATION 1...63
  hypothetical: YES
CLAQISILHFDFLSIDKHSHTVFNTLRKSLQTTLALSATSKQCFEQLAASFLVCSLIFIEYKV

SEQ ID NO: 3267 - protein, 140 aa, Streptococcus pneumoniae
  misc_feature (B) LOCATION 1...140
  hypothetical: YES
PMAQLTVQIVTPDGLVYDHHASYVSVRTLDGEMGILPRHENMIAVLAVDEVKVKRIDDKDHVNWIAVNGGVIEIANDMITIVADSAERARDIDISRAERAKLRAERAIEEAQDKHLIDQERRAKIALQRAINRINVGNRL

SEQ ID NO: 3268 - protein, 224 aa, Streptococcus pneumoniae
  misc_feature (B) LOCATION 1...224
  hypothetical: YES
QIYHLGQPIFRSFGQFFNGVLFTLALAIGSFILAMVLGIFFGARSTSKRPILRILARIFVEFYQNTPLLVQFVIVFYGLPLISDHIIMIPIYWTAVLCVGLYHGAYIAEVIRSGIQSIPSGQMEAALSQGFTYISAMRLIILPQAFRIILPPLTNQIVNLIKNTSTVAIISGVDLMFVTKSWSALNGNYIPAFLGAALLYFALCFPVAQFGRKMEQANKKAYSL

SEQ ID NO: 3269 - protein, 61 aa, Streptococcus pneumoniae
  misc_feature (B) LOCATION 1...61
  hypothetical: YES
KAYQGRKIGSQLLATLESELAKKVGYLQVKTVAEGSNKDYDRTNDFYRGLGFKKLEICLQL

SEQ ID NO: 3270 - protein, 217 aa, Streptococcus pneumoniae
  misc_feature (B) LOCATION 1...217
  hypothetical: YES
KEDLMKIALINENSQASKNHIIYDSLKEATDKKGYQLFNYGMRGEEGESQLTYVQNGLMAAILLNTKAVDFVVTGCGTGVGAMLALNSFPGVVCGLAVDPTDAYLYSQINGGNALSIPYAKGFGWGAELTLKLMFERLFAEEMGGGYPRERVIPEQRNARILNEVKQITHNDLMTILKIIDQDFLKDTISGKYFQEYFFENCQDDEVAAYLKEVLAK

SEQ ID NO: 3271 - protein, 88 aa, Streptococcus pneumoniae
  misc_feature (B) LOCATION 1...88
  hypothetical: YES
YNYQKTKGVHLMVELNLKNIYKKYPNSEHYSVEDFNLNIKDKEFIVFVGPSGCGKSTTLRMIAGLEDITEGTASIDGVVVNDVAPKDQ

SEQ ID NO: 3272 - protein, 113 aa, Streptococcus pneumoniae
  misc_feature (B) LOCATION 1...113
  hypothetical: YES
NNYQKTRKKIMSLTSKQRAFLNSQAHTLKPIIQIGKNGLNDQIKTSVRQALDARELIKVTLLQNTDENIHEVAEILEEEIGVDTVQKIGRILILFKQSSKKENRKISKKVKEI

SEQ ID NO: 3273 - protein, 473 aa, Streptococcus pneumoniae
  misc_feature (B) LOCATION 1...473
  hypothetical: YES
SLYHKRGDWDRMEVKAVFFDIDGTLVNNRKSVLKSTKDAIKIVKEQGVLVGVATGRGPFFVKELMDDLDLDFAVTYNGQYIFSKDRVLFTSPISKLHLRHLISYAKKEGTEIALGTKDAMLGSKIMSFGLGSFSQRISRFVPSVLTRTVSQSFNRMVSKVVPQKEEDLLHLMNQPIYQVLMLMTPEESEKAAADFEDLKLTRSNPFASDVINQGNSKLEGIRRVGKEYGFDLNQVMAFGDSDNDLEMLAGVGMSVAMGNGSSSVKEAAKHITTSNQQDGIHKALEHFGVLSSEKVFVSRDYHFNKVKTFHHMMDERTQEEPRAWDLEGATHRAGFKIEELVEFVRAASPSEEDFGQGVWQFHQALDKAADKVAKKTPAQQDLIGQVDALIDTLYFTYGSFVLMGVDPERIFDIVHQANMGKIFPDGKAHFDPVTHKILKPDNWEEKYAPEPAIKKELQRQLKAYERHKERNKS

SEQ ID NO: 3274 - protein, 237 aa, Streptococcus pneumoniae
  misc_feature (B) LOCATION 1...237
  hypothetical: YES
RVDLMAYIEMKHCYKRYQVGDTEIVANRDVNFEIEKGELVIILGASGAGKSTVLNLLGGMDTNDEGEIWIDGVNIADYSSHQRTNYRRNDVGFVFQFYNLVSNLTAKENVELASEIVTDALNPDQVLTDVGLAHRLNNFPAQLSGGEQQRVSIARAVAKNPKILLCDEPTGALDYQTGKQVLKILQDMSRQKGATVIIVTHNGALAPIADRVIHMHDASVKDVVLNQHPQDIDSLEY

SEQ ID NO: 3275 - protein, 188 aa, Streptococcus pneumoniae
  misc_feature (B) LOCATION 1...188
  hypothetical: YES
NVNQPWSSLVVVKIQQPAFSRAHGSMKQSKLSPLAYGNIITSKFKLLEKSPRNRGIRHPYPRYVSAGTNHCSTTTLRRFHISYISDKLCVESKSLKLYLFSYRNHGDFHENCINTIGKDLVNLVDLRYLEIGGNLFRAVACQSTPITITVSKEISMRXWQNNAFSNTTFIQRKLTTAKVILNENQRAN

SEQ ID NO: 3276 - protein, 276 aa, Streptococcus pneumoniae
  misc_feature (B) LOCATION 1...276
  hypothetical: YES
KENHLMSKYLLKLLVYCFSALTFGSLFLIIGFILIKGLPHLSLSLFSWTYTSENISLMPAIISTVILVFGALLLALPIGIFAGFYLVEYTKKDSLCVKIMRLASDTLSGIPSIVFGLFGMLFFVVFLGFQYSLLSGILTSVIMVLPVIIRSTEEALLSVSDSMRQASYGLGAGKLRTVFRIVLPVAMPGILAGVILAIGRIVGETAALMYTLGTSTNTPSSLMSSGRSLALHMYMLSSEGLHVNEAYATGVILIITVLMINTLSSLLSRKLVKGAS

SEQ ID NO: 3277 - protein, 65 aa, Streptococcus pneumoniae
  misc_feature (B) LOCATION 1...65
  hypothetical: YES
RLRQNFSGYFFHTFIEAWGQNVFHKAQKFSHRNLKIGEDIDHHQKQGENRNQPIVGYCDTGQLTI

SEQ ID NO: 3278 - protein, 63 aa, Streptococcus pneumoniae
  misc_feature (B) LOCATION 1...63
  hypothetical: YES
CRRQSVLAGSKLGRAIEYSLKYEETFKTILKDGHLVLSNNLAERAIKSLVMGRSKRIQWTLLA

SEQ ID NO: 3279 - protein, 323 aa, Streptococcus pneumoniae
  misc_feature (B) LOCATION 1...323
  hypothetical: YES
PLCLVPACPVGLSSYQYSQLLQHFPENHWPILLFVGITSVLLLLWGGIATYMEAPDKLFLLVGEEEIKLHLKRQTGISLVFWLFVQTLFLLLFAPLFLAMGYGLPVFLLYVLLLGVGKYFHFRQKASKFFTETGLDWDYLISQESKRKQVLLRFFALFTQVKGISNSVKRRAYLDFILKAVQKVPGKIWQNLYLRSYLRNGDLFALSLRLLLLSVLAQVFIEQAWIATAVVVLFNYLLLFQLLALYHAFDYQYLTQLFPLDKGQKEKGLQEVVRGLTSFVLLVEVVVGLITFQEKLALLALLGAGLVLLVLYLPYQVKRQMQD

SEQ ID NO: 3280 - protein, 68 aa, Streptococcus pneumoniae
  misc_feature (B) LOCATION 1...68
  hypothetical: YES
QEFQFIWSFQHHFFPSVAGPGPDVLVWQFLPNPLNKWQENPSIKKRLPSQQSQTLNIGLSKICHDLLF

SEQ ID NO: 3281 - protein, 239 aa, Streptococcus pneumoniae
  misc_feature (B) LOCATION 1...239
  hypothetical: YES
TKIQKKLKHSLKQLHQNFLHQILLKQVSLLTALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 3282 - protein, 235 aa, Streptococcus pneumoniae
  misc_feature (B) LOCATION 1...235
  hypothetical: YES
RRIHLMVKLVFARHGESEWNKANLFTGWADVDLSEKGTQQAIDAGKLIKEAGIEFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERAFPFWEDKIAPAFKDGKNVFVGAHGNSIRALVKHIKGLSDDEIMDVEIPNFPPLVFEFDEKLNVVSEYYLGK

SEQ ID NO: 3283 - protein, 286 aa, Streptococcus pneumoniae
  misc_feature (B) LOCATION 1...286
  hypothetical: YES
RMIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIF

SEQ ID NO: 3284 - protein, 362 aa, Streptococcus pneumoniae
  misc_feature (B) LOCATION 1...362
  hypothetical: YES
AFSHVNINTKSLVELLHIIECFHKTHFTKISCFFQEETHTMLLIFLSSLAILRQVWYNKNMRIQQLHYIIKIVETGSMNEAAKQLFITQPSLSNAVRDLENEMGIEIFIRNPKGITLTRDGMEFLSYARQVVEQTQLLEERYKNPVAHRELFSVSSQHYAFVVNAFVSLLKKSDMEKYELFLRETRTWEIIDDVKNFRSEVGVLFLNSYNRDVLTKMLDDNHLLAHHLFTAQPHIFVSKTNPLAKKDKVKLSDLENFPYLSYDQGTHNSFYFSEEILSQEHHKKSIVVSDRATLFNLLIGLDGYTIATGILNSNLNGDNIVSIPLDIDDPIELVYIQHEKTSLSKMGERFIDYLLEEVQFDS

SEQ ID NO: 3285 - protein, 75 aa, Streptococcus pneumoniae
  misc_feature (B) LOCATION 1...75
  hypothetical: YES
LYSQIRPRFWRFALQILLWDSLMILSLVSLSDIPLFLQGTLLILGHLIPSYRICQSLKRDFPQAYQEPISFWSIL

SEQ ID NO: 3286 - protein, 71 aa, Streptococcus pneumoniae
  misc_feature (B) LOCATION 1...71
  hypothetical: YES
ERSQLRLLKSYFREFSLWIGKIIYHLELGSRFQKLNVLSPNFTMSPVFRLFLRKLLSRNCRNTMLAQKGFL

SEQ ID NO: 3287 - protein, 62 aa, Streptococcus pneumoniae
  misc_feature (B) LOCATION 1...62
  hypothetical: YES
VSSQFAIIAVCLIFQAPACFGSELVGIVANSIRMFCVREISAVGHFLTSFIDCNIGNSYLVS

SEQ ID NO: 3288 - protein, 252 aa, Streptococcus pneumoniae
  misc_feature (B) LOCATION 1...252
  hypothetical: YES
LLCLLTIFWYNSREKGEHMKKILIVDDEKPISDIIKFNMTKEGYEVVTAFNGREALEQFEAEQPDIIILDLMLPEIDGLEVAKTIRKTSSVPILMLSAKDSEFDKVIGLELGADDYVTKPFSNRELQARVKALLRRSQPMPVDGQEADSKPQPIQIGDLEIVPDAYVAKKYGEELDLTHREFELLYHLASHTGQVITREHLLETVWGYDYFGDVRTVDVTVRRLREKIEDTPSRPEYILTRRGVGYYMRNNA

SEQ ID NO: 3289 - protein, 367 aa, Streptococcus pneumoniae
  misc_feature (B) LOCATION 1...367
  hypothetical: YES
NVAQVISLPATQTQQKLKQNSVGKQNSTSPKCVKTHGVGKASIQMDLKTKMMISIIVPCLNEEEVLPLFYQALEALLPDLETEIEYVFVDDGSSDGTLELLKAYREQNPAVHYISFSRNFGKEAALYAGLQYATGDLVVVMDADLQDPPSMLFEMKNVLDKNVDLDCVGTRRTSREGEPFFRSFCAVLFYRLMQKISPVALPSGVRDFRMMRRSVVDAILSLTESNRFSKGLFAWVGFKTHYLDYPNVERQAGKTSWSFRQLFFYSIEGIVNFSDFPLTIAFVAGLLSCFLSLLMTFFVVVRTLILGNPTSGWTSLMAVILFLGGIQLLTIGILGKYISKIYLETKKRPLYLIKEKSDDRLKKIEFI

SEQ ID NO: 3290 - protein, 241 aa, Streptococcus pneumoniae
  misc_feature (B) LOCATION 1...241
  hypothetical: YES
RVYQSKRSAHRRLYFRTVRIRKEKPMRNQFDLELHELEQSFLGLGQLVLETASKALLALASKDKEMAELIINKDHAINQGQSAIELACARLLALQQPQVSDLRFVISIMSSCSDLERMGDHMAGIAKAVLQLKENQLAPDEEQLHQMGKLSLSMLADLLVAFPLHQASKAISIAQKDEQIDQYYYALSKEIIGLMKDQETSIPNGTQYLYIIGHLERFADYIANICERLVYLETGELVDLN

SEQ ID NO: 3291 - protein, 117 aa, Streptococcus pneumoniae
  misc_feature (B) LOCATION 1...117
  hypothetical: YES
ESYHGSRVTMYFPTSSALIEFLILAVLEQGDSYGYEISQTIKLIANIKESTLYPILKKLEGNSFLTTYSREFQGRMRKYYSLTNGGIEQLLTLKDEWTLYTDTINGIIEGSIRHDKN

SEQ ID NO: 3292 - protein, 572 aa, Streptococcus pneumoniae
  misc_feature (B) LOCATION 1...572
  hypothetical: YES
MSYQENYQKWVDFVELPDYLRQDLENMDEKTKEDAFYTNLEFGTAGMRGLVGAGTNRINIYVVRQATEGLARLIESKGGNEKERGVAIAYDSRHFSPEFAFESAAVLAKHGIKSYVFESLRPTPELSFAVRHLNCFAGIMVTASHNPAPFNGYKVYGEDGGQMPPHDADALTTYIRAIENPFAVEVADVETEKASGLIEVIGEAVDVKYLKEVKDVNINPALIEEFGKDMKIVYTPLHGTGEMLARRALAQAGFDSVQVVEAQATADPDFSTVTSPNPESQAAFALAEELGRQVGADVLVATDPDADRVGVEVLQKDGSYLNLSGNQIGAIMAKYILEAHKNAGTLPENAALCKSIVSTDLVTKIAESYGATMFNVLTGFKFIAEKIQEFEEKHNHTYMMGFEESFGYLIKPFVRDKDAIQAVLVVAELAAYYRSRGLTLADGIEEIYKEYGYYAEKTISVTLSGVDGAEQIKAIMAKFRNNAPKEWNATAITVVEDFKAQTATVADGTVTNLTTPPSDVLKYTLADGSWIAVRPSGTEPKIKFYIAVVGETNEESQAKIANIEAEINAFVK

SEQ ID NO: 3293 - protein, 148 aa, Streptococcus pneumoniae
  misc_feature (B) LOCATION 1...148
  hypothetical: YES
QRYQNIMVAIDGSKEADLAFVKGVHSALRNDAKLTIAHVIDTRALQSVSTFDAEVYEELQVDAESLMKEYEKRAKDAGVADVHIVIEMGNPKTLLARTIPDAEEVDLILVGATGLNAFERLLVGSSSEYILRHAKVDLLVVREQEKTL

SEQ ID NO: 3294 - protein, 89 aa, Streptococcus pneumoniae
  misc_feature (B) LOCATION 1...89
  hypothetical: YES
RLHQQTSRYRIMMLSSLIWISLIQNTRENMVAKKKILFFMWSFPLGGGAEKILSTIVSNLDPEKYDIDILEMEHFDKGYESFPKHVRIL

SEQ ID NO: 3295 - protein, 291 aa, Streptococcus pneumoniae
  misc_feature (B) LOCATION 1...291
  hypothetical: YES
PYHQKKNASTVMNFTLINWRIRMQYLEKKEIKEIQLALLDYIDETCKKYDIPYFLSYGTMLGAIRHKGMIPWDDDIDISLYREDYERLLKIIEEENHPRYKVLSYDTSSWYFHNFASILDTSTVIEDHVKYKRHDTSLFIDVFPIDRFTDLSIVDKSYKYVALRQLAYIKKSRAVHGDSKLKDFLRLCSWYALRFVNPRYFYKKIDQLVKNAVTNTPQYEGGVGIGKEGMKEIFPVDTFKELILTEFEGRMLPVPKKYDQFLTQMYGDYMTPPSKEMQEWYSHSIKAYRKS

SEQ ID NO: 3296 - protein, 291 aa, Streptococcus pneumoniae
  misc_feature (B) LOCATION 1...291
  hypothetical: YES
TINQLSNREEFLQFRNELQLEISNRKRVSMKINKKYLVGSAAALILSVCSYELGLYQARTVKENNRVSYIDGKQATQKTENLTPDEVSKREGINAEQIVIKITDQGYVTSHGDHYHYYNGKVPYDAIFSEELLMKDPNYKLKDEDIVNEVKGGYVIKVDGKYYVYLKDAAHADNVRTKEEINRQKQEHSPHREKLDSKKTKFPLPWGPFARDAILQMMVISLMLLISYRILVMLISFLMEIITITFLRMSYQLASWLLQKPSYLVGEICQIQEPIADKIAITLQEQTGYLL

SEQ ID NO: 3297 - protein, 78 aa, Streptococcus pneumoniae
  misc_feature (B) LOCATION 1...78
  hypothetical: YES
YKNQAEEDKPLSDKYIFEKILGKTYAAFKKDQINERVEKLGKLKPITINYNGKSEVIDSKEKLQELMNKAVKDEVAQI

SEQ ID NO: 3298 - protein, 392 aa, Streptococcus pneumoniae
  misc_feature (B) LOCATION 1...392
  hypothetical: YES
CYCQIPNSGILGQYFINMKEIFMAKKGTLTGLLLFGIFFGAGNLIFPPSLGALSGEHFLPAIAGFVFSGVGIAVLTLIIGTLNPKGYIYEISAKIAPWFATLYLSVLYLSIGPFFATPRTATTAYEVGISPLLSDANKGLGLIVFTVLYFAAAYLISLNPSKILDRIGRILTPVFAILIVILVVLGAIKYGGTSPQTASSAYQASAFGTGFLEGYNTLDALASVAFIVIAVQTLKQLGFSSKKKYISTIWVVGIVVALAFSALYIGLGFLGNHFPVPAEAMKGGTPGVYILSQATQEIFGSTAQLFLAAMVTVTCFTTTVGLIVSTAEFFNERFAQISYKVYATAFTLIGFAIGXSXXNXXXXXFXKNINSLVKNVHXPKIYNFPPLPPFLX

SEQ ID NO: 3299 - protein, 224 aa, Streptococcus pneumoniae
  misc_feature (B) LOCATION 1...224
  hypothetical: YES
LACQSHRHMWFLALRSGILMKTKLIFWGSMLFLLSLSILLTIYLAWIFYPMEIQWLNLTNRVYLKPETIQYNFHILMNYLTNPFSQVLQMPDFRSSAAGLHHFAVVKNLFHLVQLVALVTLPSFYVFVNRIVKKDFLSLYRKSLLALVVLPVMIGLGGVLIGFDQFFTLFHQILFVGDDTWLFDPAKDPVIMILPETFFLHAFLLFFALYENFFGYLCVKSRRK

SEQ ID NO: 3300 - protein, 231 aa, Streptococcus pneumoniae
  misc_feature (B) LOCATION 1...231
  hypothetical: YES
GSSQSVGDTYIQHSTGVPDGKEGFAAFFADFFERHPERQIKIVRTIEDGNLVFVHVHQYLNGGEAQWVTTDTFREDENGCIVEHWDVIDYYRTPENDQLDQIFGDFEIKDLDKKAENKKLVRRFLTEIFQNGELEQWSDYVADDLIQHNHEIGQGSAAYKNYVAEYSVTFDFVFQLLGQGNYVVSYGQTQIDGVAYAQYDIFRLENGKIVEHWDNKEVMPKVEDLTNRGKF

SEQ ID NO: 3301 - protein, 165 aa, Streptococcus pneumoniae
  misc_feature (B) LOCATION 1...165
  hypothetical: YES
FSSLIKEAENELQRSIRCTIILSLVLISLAHSFGSVSIIAHTIHQKFNLKVPNYRQEEDWARMGLPITRKEISNWHIKASQYYLESLYNLLREKLLEQPLLHADETSYRVLESDSHLTYYWTFLSGKAENQAITLYHHDQRRSGLVVQEFLGDYSGYVHCDMLRQ

SEQ ID NO: 3302 - protein, 191 aa, Streptococcus pneumoniae
  misc_feature (B) LOCATION 1...191
  hypothetical: YES
TYSLICLQGGNMQESNKRLKTKRTIENAMVQLLMEQPFDKISTVKLVEKAGISRSSFYTHYKDKYDMIEHYQSKLFHTFEYIFQKHAHHKRDAILEVFEYLESEPLLAVLLSENGTKEIQNFLRNKLHIMLSTDLQKRFMQLNLNTTELEYSSIYLTHALFGVCQTWIAHGKKESSQEITDFLMKMLGDTN

SEQ ID NO: 3303 - protein, 75 aa, Streptococcus pneumoniae
  misc_feature (B) LOCATION 1...75
  hypothetical: YES
MFLHHFTEIYDTFAPFLPLLSKQKNRKPEPAVKEQFRKFPFYLFNCNQAIWLYCELWLVCHATVWFEVVPACSVR

SEQ ID NO: 3304 - protein, 65 aa, Streptococcus pneumoniae
  misc_feature (B) LOCATION 1...65
  hypothetical: YES
ILLQTVKENVLRLRFGLDDGKMRTLEDVGKVFNVTRERIRQIEAKALRKLRQPSRSKPLRDFIED

SEQ ID NO: 3305 - protein, 344 aa, Streptococcus pneumoniae
  misc_feature (B) LOCATION 1...344
  hypothetical: YES
IGSLTIILLKQVTLKRNRLRKQFSIKTSVRLSILLLTEHLMGLSLKGKEGATKILRNLVVPPNFVSIKGKDFGEVVASKMVNYGKEWQGINFADGQDPYYNPEKAKAKFAEAKKELEAKGVQFPIHLDKTVEVTDKVGIQGVSSIKQSIESVLGSDNVVIDIQQLTSDEFDSSGYFAQTAAQKDYDLYHGGWGPDYQDPSTYLDIFNTNSGGVLQNLGLEPGEANDKAKAVGLDVYTQMLEEANKEQDPAKRYEKYADIQAWLIDSSLVLPSVSRGGTPSLRRTVPFAAAYGLTGTKGVESYKYLKVQDKIVTTDEYAKAREKWLKEKEESNKKAQEELAKHVK

SEQ ID NO: 3306 - protein, 109 aa, Streptococcus pneumoniae
  misc_feature (B) LOCATION 1...109
  hypothetical: YES
GGSLMIQPASLEELASLVEKDGKKVFLFVADWCGDCRYIYPALPEIEESNPEFTFIRVDRDQYIDLAKLWDVYGIPSLVVLEKDKEIGRFVNRDRKSKQQINDFLAGLK

SEQ ID NO: 3307 - protein, 170 aa, Streptococcus pneumoniae
  misc_feature (B) LOCATION 1...170
  hypothetical: YES
KLLQCRKRKEALMTSLYDFSVLNQNNQATPLDSYRGKVLLIVNTATGCGLTPQYQGLQELYERYQDQGFEILDFPCNQFMGQAPGSAEEINAFCSLHFQTTFPRFAKIKVNGKEADPLYVWLKDHKSGPLGKRIEWNFAKFLISRDGQVFERFSSKTDPKQIEEAIQTLL

SEQ ID NO: 3308 - protein, 331 aa, Streptococcus pneumoniae
  misc_feature (B) LOCATION 1...331
  hypothetical: YES
SLSLCAYALNQHRAQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARIGAYQWNWFYSFYKCKT

SEQ ID NO: 3309 - protein, 296 aa, Streptococcus pneumoniae
  misc_feature (B) LOCATION 1...296
  hypothetical: YES
VVIQGVSMQIQKSFKGQSPYGKLYLVATPIGNLDDMTFRAIQTLKEVDWIAAEDTRNTGLLLKHFDISTKQISFHEHNAKEKIPDLIGFLKAGQSIAQVSDAGLPSISDPGHDLVKAAIEEEIAVVTVPGASAGISALIASGLAPQPHIFYGFLPRKSGQQKQFFDSKKDYPETQIFYESPHRVADTLENMLEVYGDRSVVLVRELTKIYEEYQRGTISELLESIAETSLKGECLLIVEGASQDVEEKDEEDLFLEIQARIQQGMKKNQAIKEVAKIYQWNKSQLYAAYHDWEEKQ

SEQ ID NO: 3310 - protein, 280 aa, Streptococcus pneumoniae
  misc_feature (B) LOCATION 1...280
  hypothetical: YES
KESLMTVVKVEKLSKKIKDKEILRNISFEINDGECVALIGPNGAGKTTLLDCLLGDKLVTSGQVSIQGLPVTSSKLDYTRAYLPQENIIVQKLKVKELIAFFQRIYPNPLSNQEIDQLLQFVKQQKEQLAEKLSGGQKRLFSFILTLIGRPKIVFLDEPTASMDTSTRQRFWEIVQELKAQGVTILYSSHYIEEVEHTADRILLLNKGELIRDTTPLAMRSEEIEKHFILPIAYKEVVEQSNLVENWTLKQDSLQVVTREADAFWELLAQAGCRMQRNRS

SEQ ID NO: 3311 - protein, 108 aa, Streptococcus pneumoniae
  misc_feature (B) LOCATION 1...108
  hypothetical: YES
PEIQYWLGQFSRQKEGRDLQEIFARFTNFNFCRWVTSQVAIDSSHKKQRYKVCFSDAAYACRLFFNGSLSSLQLKNYLKKQLSIIRPNRKYSRKIKAQSVVDFIYRVT

SEQ ID NO: 3312 - protein, 64 aa, Streptococcus pneumoniae
  misc_feature (B) LOCATION 1...64
  hypothetical: YES
AEIQEMREDFYEKVSTSIQNKCSLLLLIFRIWSFSADAYRPKLLAIFFPDWQFRLDSKYLEFTI

SEQ ID NO: 3313 - protein, 172 aa, Streptococcus pneumoniae
  misc_feature (B) LOCATION 1...172
  hypothetical: YES
RRIHMSLLDIAKSIKKEGFDPRKDSANGPAPIPAGTYPVVLKKATFNVSDKGWESLGYQFEIRGGDYSGRSEFATFGTLTEWNGKNLDWAVERTMKFFIKALVLAGDSMQGNEEDGKALEEALQRKAVGSYYNLVISVTKGKDGREFRNYDLEEEEAQPLTEADIDEDDLPF

SEQ ID NO: 3314 - protein, 132 aa, Streptococcus pneumoniae
  misc_feature (B) LOCATION 1...132
  hypothetical: YES
SCSHLISIHYRRRKRMILRHLGISPTNDLVAKKIFSNPEITCQFIRDMLDLPAKNVTILEGSNIHVLPSMPYSVQDFYTSIDVLAELDNGTQVIIEIQVHHQNFFINHLWAYLCSQVNQNLEKIHQREGDTH

SEQ ID NO: 3315 - protein, 122 aa, Streptococcus pneumoniae
  misc_feature (B) LOCATION 1...122
  hypothetical: YES
FISHKVEVFYHIVFTPKYRRKVIYNQYRSSLGEIFHRLCSYKGVEMIEGHLMPDHVHMLVSIPSRLSVSSFMGYLKGKSALMMFDKHANLKYKFGNRHFWAEGYYVSPVGLNEATIKKYSQD

SEQ ID NO: 3316 - protein, 104 aa, Streptococcus pneumoniae
  misc_feature (B) LOCATION 1...104
  hypothetical: YES
GLSHITQKKKEQKESQTMASKDFHVVAETGIHARPATLLVQTASKFASDITLEYKGKSVNLKSIMGVMSLGVGQGADVTISAEGADADDAIAAISETMEKEGLA

SEQ ID NO: 3317 - protein, 82 aa, Streptococcus pneumoniae
  misc_feature (B) LOCATION 1...82
  hypothetical: YES
PHGLHGNEPSPLPWMNKKTLPNNPATSKDSHGVAAPNCSANSRLKTTPEKAPITIIPSRPTFTTPPRSEKTPPILVKMRGAE

SEQ ID NO: 3318 - protein, 328 aa, Streptococcus pneumoniae
  misc_feature (B) LOCATION 1...328
  hypothetical: YES
FFTQSLHESGINLYKDLLDYKCSKPTQEKYIEIKVIIMKFKKMLTLAAIGLSGFGLVACGNQSAASKQSASGTIEVISRENGSGTRGAFTEITGILKKDGDKKIDNTAKTAVIQNSTEGVLSAVQGNANAIGYISLGSLTKSVKALEIDGVKASRDTVLDGEYPLQRPFNIVWSSNLSKLGQDFISFIHSKQGQQVVTDNKFIEAKTETTEYTSQHLSGKLSVVGSTSVSSLMEKLAEAYKKENPEVTIDITSNGSSAGITAVKEKTADIGMVSRELTPEEGKSLTHDAIALDGIAVVVNNDNKASQVSMAELADVFSGKLTTWDKIK

SEQ ID NO: 3319 - protein, 186 aa, Streptococcus pneumoniae
  misc_feature (B) LOCATION 1...186
  hypothetical: YES
LRTHQKNQVTKNHLLQNQVCNQVLNQRLNRSWKNQNQRLNRNQKNQNQRLNRSRKNQNQRLNRSRKNQNQRLNRSRKNQNQRLNRSRKNQNQRLNRSRKNQNQRLNRSRKNQNQRLNRSRKNQNQRLNRSRKNQNQRLNRSRKNQNQRLNRNQKNQNQRLNRNQKNQNQIIASHKQMIRSHQLQII

SEQ ID NO: 3320 - protein, 144 aa, Streptococcus pneumoniae
  misc_feature (B) LOCATION 1...144
  hypothetical: YES
PKAHIKLLANQQKHSDAGATIEDEYYVFIAESKIDGKKEVIQCCMGAARDFLELINHKGLPFFNPLVGDSHVNNRQEYDNTGSGNLQPEKWNETAQQLYNAIMWLIILWNAKPDTPLFIFKDEVIKYKTYEPFESSIKLVSINE

SEQ ID NO: 3321 - protein, 192 aa, Streptococcus pneumoniae
  misc_feature (B) LOCATION 1...192
  hypothetical: YES
KMAHLLEKTRKITSILKRSEEQLQDELPYNAITRQLADIIHCNACIINSKGRLLGYFMRYKTNTDRVKQFFQTKIFPDDYVQGANMIYETEANLPVEHDMSIFPVESRDDFPDGLTTIAPIHVSGIRLGSLIIWRNDKKFEDEDLVLVEIASTVVGIQLLNFQREEDEKNIRRRTAVTMAVNTLSYSELRAV

SEQ ID NO: 3322 - protein, 191 aa, Streptococcus pneumoniae
  misc_feature (B) LOCATION 1...191
  hypothetical: YES
IIQQNKKLVKQKEELFWESLKKWYNEKKTIRRERMRCPKCGATKSSVIDSRQAEEGNTIRRRRECDECQHRFTTYERVEERTLVVVKKDGTREQFSRDKIFNGIIRSAQKRPVSSDEINMVVNRIEQKLRGRNENEIQSEDIGSLVMEELAELDEITYVRFASVYRSFKDVSELESLLQQITQSSKKKKER

SEQ ID NO: 3323 - protein, 710 aa, Streptococcus pneumoniae
  misc_feature (B) LOCATION 1...710
  hypothetical: YES
LSKQKEVKNMNNNFNNFNNMDDLFNQLMGGMRGYSSENRRYLINGREVTPEEFAHYRATGQLPGNAETDVQMPQQASGMKQDGVLAKLGRNLTAEAREGKLDPVIGRNKEIQETSEILSRRTKNNPVLVGDAGVGKTAVVEGLAQAIVNGDVPAAIKNKEIISIDISGLEAGTQYRGSFEENVQNLVNEVKEAGNIILFFDEIHQILGAGSTGGDSGSKGLADILKPALSRGELTVIGATTQDEYRNTILKNAALARRFNEVKVNAPSAENTFNILQGIRDLYQQHHNVILPDEVLKAAVDYSVQYIPQRSLPDKAIDLVDVTAAHLAAQHPVTDVHAVEREIETEKDKQEKAVEAEDFEAALNYKTRIAELERKIENHTEDMKVTASVNDVAESVERMTGIPVSQMGASDIERLKDMAHRLQDKVIGQDKAVEVVARAIRRNRAGFDEGNRPIGSFLFVGSTGVGKTELAKQLALDMFGTQDAIIRLDMSEYSDRTAVSKLIGTTAGYVGYDDNSNTLTERVRRNPYSIILLDEIEKADPQVITLLLQVLDDGRLTDGQGNTVNFKNTVIIATSNAGFGYEANLTEDADKPELMDRLNPFFRPELLNRFNAVIEFSHLTKEDLSKIVDLMLAEVNQTLAKKDIDLVVSQAAKDYITEEGYDEVMGVRPLRRVVEQEIRDKVTDFHLDHLDAKHLEADMEDGVLVIREKA

SEQ ID NO: 3324 - protein, 121 aa, Streptococcus pneumoniae
  misc_feature (B) LOCATION 1...121
  hypothetical: YES
IYKHIAPVYVIAIVDSNYFSDDLAFHSFSMREDTTGEVLAITNNGQENHLVKMAFLELKNTEKPAKTRFASHGWSFSATSPLPSNRNEPLAKQINCWTTRAGPRRTGKCLVNYICEKNKSC

SEQ ID NO: 3325 - protein, 174 aa, Streptococcus pneumoniae
  misc_feature (B) LOCATION 1...174
  hypothetical: YES
CSKHRFEVADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSSKHRFEVADRTDEVSNIYTARRS

SEQ ID NO: 3326 - protein, 235 aa, Streptococcus pneumoniae
  misc_feature (B) LOCATION 1...235
  hypothetical: YES
MTKQVLLVDDEEHILKLLDYHLSKEGFSTQLVTNGRKALALAETEPFDFILLDIMLPQLDGMEVCKRLRAKGVKTPIMMVSAKSDEFDKVLALELGADDYLTKPFSPRELLARVKAVLRRTKGEQEGDDSDNIADDSWLFGTLKVYPERHEVYKANKLLSLTPKEFELLLYLMKHPNMTLTRERLLERIWGYDFGQETRLVDVHIGKLREKIEDNPKAPQFIRTIRGYGYKFKEL

SEQ ID NO: 3327 - protein, 414 aa, Streptococcus pneumoniae
  misc_feature (B) LOCATION 1...414
  hypothetical: YES
LAKQFVLKTELALNVFLETIKDKYGFTIKTFDTGDLMNNSLSAGAIDAMMDDKPVIEYAINQGQDLHIEMDGEAVGSFAFGVKKGSKYEHLVTEFNQALAEMKKDGSLDKIIKKWTASSSSAVPTTTTLAGLKAIPVKAKYIIASDSSFAPFVFQNSSNQYTGIDMELIKAIAKDQGFEIEITNPGFDAAISAVQAGQADGIIAGMSVKDARKATFDFSESYYTANTILGVKESSNIASYEDLKGKTVGVKNGTASQTFLTENQSKYGYKIKTFADGSSMYDSLNTGAIDAVMDDEPVLKYSISQGQKLKTPISGTPIGETAFAVKKGANPELIEMFNNGLANLKANGEFQKILDKYLASESSTASTSTVDETTLWGLLQNNYKQLLSGLGITLALDSYLICYCHCHRNYLRYV

SEQ ID NO: 3328 - protein, 206 aa, Streptococcus pneumoniae
  misc_feature (B) LOCATION 1...206
  hypothetical: YES
KMKQERFPLVSDDEVMLTEMPVMNLYDESDLISNIKGEYRDKNYLEWAPITEEKPVKPIEKQVEKPKKAPLGVKKEGKSYAEVAREEARADLKKKRSANYLTQDFSLARRHSQPSLVRQGNQPTAPFQKENPGEFVKYSQKLTQSHYILAEEVHSIPTKNEEVSAPAPKKNNYDFLKKSQIYNKKSKQTEQERRVAQELNLTRMTE

SEQ ID NO: 3329 - protein, 158 aa, Streptococcus pneumoniae
  misc_feature (B) LOCATION 1...158
  hypothetical: YES
LPEHTFYVDNLFVFTPLQQVKTMYYLPVDFYRYLIGREDQSVNEQVMIKCIDQQLKVNRLLVDQLDLSQVSHPKMREYLLNHIEITTVISSTLLNRSGTTEHLAKKRQLWTYIQQKNPEVFQAIRKTMLSRLTKHSVLPDRKLSNVVYQITKSVYGFN

SEQ ID NO: 3330 - protein, 86 aa, Streptococcus pneumoniae
  misc_feature (B) LOCATION 1...86
  hypothetical: YES
VLEHTMEVVMDNIIDVSIPVAEVVDKHPEVLEILVELGFKPLANPLMRNTVGRKVSLKQGSKLAGTPMDKIVRTLEANGYEVIGLD

SEQ ID NO: 3331 - protein, 327 aa, Streptococcus pneumoniae
  misc_feature (B) LOCATION 1...327
  hypothetical: YES
KLEHSSRKHFVKIVKEPGLKGALRSFIHPEKQTFEAVKDLTFEVPKGQILGFIGANGAGKSTTIKMLTGILKPTSGFCRINGKIPQDNRQDYVKDIGVVFGQRTQLWWDLALQETYTVLKEIYDVPNSLFHKRMDFLNEVLDLKDFIKDPVRTLSLGQRMRADIAASLLHNPKVLFLDEPTIGLDVSVKDNIRRAITQINQEEETTILLTTHDLSDIEQLCDRIFMIDKGQEIFDGTVSQLKETFGKMKTLSFELLPGQSHLVSHYEGLSDMTIDRQGNSLNIEFDSSRYQSADIIKQTLSDFEIRDLKMVDTDIEDIIRRFYRKEL

SEQ ID NO: 3332 - protein, 188 aa, Streptococcus pneumoniae
  misc_feature (B) LOCATION 1...188
  hypothetical: YES
QDRQTSLSQPKNFANRGMSFEKMINATNDYYLSQGLAVIHKKPTPIQIVQVDYPQRSRAKIVEAYFRQASTTDYSGVYNGYYIDFEVKETKQKRAIPMKNFHPHQIQHMEQVLAQQGICFVLLHFSSQQETYLLPAFDLIRFYHQDKGQKSMPLEYIREYGYEIKAGAFPQIPYLNVIKEHLLGGKTR

SEQ ID NO: 3333 - protein, 124 aa, Streptococcus pneumoniae
  misc_feature (B) LOCATION 1...124
  hypothetical: YES
TSRQRRIDMAETNQNTDNLLDLTKITEPFELASALRYMKENGEFIRCKNVSDDFYMYRDVQKRPVIVNGRRQFKDVETVWAFNQWGGTIATINVAVLLNHEFYIMKFDAEGNPDWTVPTVEPKE

SEQ ID NO: 3334 - protein, 134 aa, Streptococcus pneumoniae
  misc_feature (B) LOCATION 1...134
  hypothetical: YES
DKRQERGLDVKIRMRNTIQFDEQLEVIDQLYDVEVHEKGDYSYLLFYNEEKEKVVIKFHGQELVMSRFSNPKTIMRFLKDSDSLAYIPTPMGMQEFIIQTSRYQVDRQKIELAYQLQNQEGHPFASYQLEITWG

SEQ ID NO: 3335 - protein, 279 aa, Streptococcus pneumoniae
  misc_feature (B) LOCATION 1...279
  hypothetical: YES
HCGHEFSGEIIDVGSDVTRVKVGDRVAVEPILAKNNLVGDYNLDPNLNFVGLAADGGFAKYCVLDGDLVHVIPDSLSYEQAALTEPAAVAVYAVRQSSLKAGDTAVVFGLGPIGLLIVEALRAAGASKIYAVELSPERQAKAEELGAIVVRPEEGETAVEAIHRLTNGGVDVSYEVTGVPVVLGQALAAVHKAGECMVVSIWEREANINPNEFAIQEKTLKGIIAYRHIFPKVLELMEQGYFSAEKLVTKKIKLENIVEEGFIELTQDKSQIKILVEPE

SEQ ID NO: 3336 - protein, 69 aa, Streptococcus pneumoniae
  misc_feature (B) LOCATION 1...69
  hypothetical: YES
AMLQVALLIQQLMILRINAGKILISGSVFVYRYSSVVLYKNLYNLMTYAVIETILLQTSRLFCYKFTCS

SEQ ID NO: 3337 - protein, 326 aa, Streptococcus pneumoniae
  misc_feature (B) LOCATION 1...326
  hypothetical: YES
KLLQQTLLQTCLEVVFMTNLIATFQDRFGDWLTALSQHLQLSLLTLLLAILLAIPLAVYLRYHEKLADWVLQIAGIFQTIPSLALLGLFIPLMGIGTLPALTALVIYAIFPILQNTITGLKGIDPSLQEAGIAFGMTRWERLKKFEIPLAMPVIMSGIRTAAVLIIGTATLATLIGAGGLGSFILLGIDRNNASLILIGALSSAVLAIAFNFLLKVMEKAKLRTIFSGFALVALLLGLSYSPALLAQKEKENLIIAGKIGPEPEILANMYKLLIEENTSMTATVTPNFGTTSFLYEALKKGDIDIYPEFTGTVTEKFASTITQGES

SEQ ID NO: 3338 - protein, 149 aa, Streptococcus pneumoniae
  misc_feature (B) LOCATION 1...149
  hypothetical: YES
YNMQKLGGGRMIEKMELGEFYKELRLARKLKQTDVACEGLTASQLSKFELGQSMLSADKLILAIQGINVTFDEFGHKLNNYQESPHMRIGRKVVNRFAHQDIAALEQLLEEVDQEQMAQTYRRLNAIVIKDAIHSLNKSYPLAEGDSEF

SEQ ID NO: 3339 - protein, 196 aa, Streptococcus pneumoniae
  misc_feature (B) LOCATION 1...196
  hypothetical: YES
NWSHRQERKRKCHYQMKKIAVFASGNGSNFQVIAEEFPVEFVFSDHRDAYVLERAKQLGVLSYAFELKEFESKTDYEAALVELLEEHQIDLVCLAGYIKIVGPTLLSAYEGRIVNIHPAYLPEFPGAHGIEDAWNAGVGQSGVTIHWVDSGVDTGQVIKQVRVPRLADDTSDRCEARIHEAEYRLYPEVVKALFTD

SEQ ID NO: 3340 - protein, 945 aa, Streptococcus pneumoniae
  misc_feature (B) LOCATION 1...945
  hypothetical: YES
GKAHDKIVMHGARAHNLKNIDVEIPRDKLVVVTGLSGSGKSSLAFDTLYAEGQRRYVESLSAYARQFLGNMEKPDVDAIDGLSPAISIDQKTTSKNPRSTVGTTTEINDYLRLLYARVGTPYCINGHGAINASSVEQIVDKVLELPERQRLQILAPVIRKKKGQHKSVIEKVQKDGYVRVRVDGEVYDVTEVPELSKSKQHNIDVVVDRIVIKEGIRSRLFDSIEAALRIAEGYVIIDTMDDSELLFSEHYACPVCGFTVPELEPRLFSFNAPFGSCSECDGLGIKLEVDTDLVVPDASKTLREGALAPWNPISSNYYPNMLEQAMKVFGVAMDKPFEDLSEEDKNLILYGSDGKEFHFHYENEFGGVRDIDIPFEGVINNIKRRYHETNSDYTRTQMRLYMNELTCGTCQGYRLNDQALSVRVGGQQGPHIGEISDLSIADHLDLVSQLTLSENEAIIARPILKEIKDRLTFLNNVGLNYLTLSRSAGTLSGGESQRIRLATQIGSNLSGVLYILDEPSIGLHQRDNDRLIASLKKMRDLGNTLIVVEHDEDTMREADYLIDVGPGAGVFGGEIVAAGTPKQVARNSKSITGQYLSGKRVIPVPEERRVGNGRFIEVIGARENNLQNVTARFPLGKFIAVTGVSGSGKSTLINSILKKAIAQKLNRNSDKPGKFKTITGIEHVDRLIDIDQSPIGRTPRSNPATYTGVFDDIRDLFAQTNEAKIRGYKKGRFSFNVKGGRCEACSGDGIIKIEMHFLPDVYVACEVCHGTRYNSETLEVHYKEKNISQVLDMTVNDAVEFFQHIPKIQRKLQTIKDVGLGYVTLGQPATTLSGGEAQRMKLASELHKRSTGKSFYILDEPTTGLHTEDIARLLKVLARFVDDGNTVLVIEHNLDVIKTADHIIDLGPEGGVGGGTIIVTGTPEEVAANEASYTGHYLKGKLHHE

SEQ ID NO: 3341 - protein, 185 aa, Streptococcus pneumoniae
  misc_feature (B) LOCATION 1...185
  hypothetical: YES
EGAQAAMPTALGYVSIGLACGTIGAPYVTPVEMGLMSLFVYAGSAQFAMLALIVVQAPVAAIAMTVFLINLRLFLLSLHASTYFRHTSLWYNIGMSSILTDETYGVLMGELAHTDKVNPMWMHGNNLNSYVAWFVGTVVGTALGGLLPNPEIFGLDFALVGMFIGIFASQFQMMQRRIPVRNLLI

SEQ ID NO: 3342 - protein, 535 aa, Streptococcus pneumoniae
  misc_feature (B) LOCATION 1...535
  hypothetical: YES
NHQQAQMLRGTALLTASNFISRLLGAVYIIPWYIWMGAYAAKANGLFTMGYTIYAWFLLVSTAGIPVAVAKQVAKYNTMREEEHSFALIRSFLGFMTGLGLVFALVLYVFAPWLADLSGVGKDLIPIMQSLAWGVLIFPSMSVIRGFFQGMNNLKPYAMSQIAEQVIRVIWMLLATFIIMKLGSGDYLAAVTQSTFAAFVGMVASFAVLIYFLAQESSLKRVFETGDKINSKRLLVDTIKEAIPFILTGSAIQIFQILDQLTFINSMSWFTNYSNEDLVVMFSYFSANPNKITMILISVGVSIGSVGLPLLTENYVKGDLKAASRLVQDSLTLLFMFLLPATVGVVMVGEPLYTVFYGKPDSLALGLFVFAVLQSIILGLYMVLSPMLQAMFRNRKAVLYFIYGSIAKLVLQLPTIALFHSYGPLISTTIALIIPNVLMYRDICKVTGVKRKVILKRTILISLLTLVMFLLIGTIQWLLGFFFQPSGRLWSFFYVALVGAMGGGLYMVMSLRTYLLDKVIGKAQADRLRAKFKLS

SEQ ID NO: 3343 - protein, 111 aa, Streptococcus pneumoniae
  misc_feature (B) LOCATION 1...111
  hypothetical: YES
QMQQITEIIIAFATSFLTVAVGGIVKAVKDYLLRKGGEKAVIIAEILAKNAVNAVEQVAAETGYKGDEKLAQARAKVRAELTKYNISMTDKDLDTFVESAVKQMNDAWKGR

SEQ ID NO: 3344 - protein, 219 aa, Streptococcus pneumoniae
  misc_feature (B) LOCATION 1...219
  hypothetical: YES
AHKQKFSPEMMVNKKQVKVGISTIYYWFHNGHLGLTKADMLYPRKRKGVKKQASPNFKPAGKSIEERPDVINFRLENGHYEIDTVLLTKIKNYCLLVLTDRRSRHQIIRLIPNKTAESVNQALTLLLGEHRILSITADNGSEFKRLSEVFPEEHIYYAHAYSSWERGSNENHNRLIRRWLPKGTKKTTPKEVAFIENWINNYPKKCLDYKSPSEFLLGG

SEQ ID NO: 3345 - protein, 219 aa, Streptococcus pneumoniae
  misc_feature (B) LOCATION 1...219
  hypothetical: YES
AHKQKFSPEMMVNKKQVKVGISTIYYWFHNGHLGLTKADMLYPRKRKGVKKQASPNFKPAGKSIEERPDVINLRLENGHYEIDTVLLTKIKNYCLLVLTDRRSRHQIIRLIPNKTAESVNQALTLLLGEHRILSITADNGSEFKRLSEVFPEEHIYYAHAYSSWERGSNENHNRLIRRWLPKGTKKTTPKEVAFIENWINNYPKKCLDYKSPSEFLLGG

SEQ ID NO: 3346 - protein, 130 aa, Streptococcus pneumoniae
  misc_feature (B) LOCATION 1...130
  hypothetical: YES
CHKHNMQVLDVVKTLLHAFALFQDTVKSLLTKKRVEEYIPHADLRLVINQPFAVTSTVGSYDVFVNVVGGGYAGQSGAIRHGIARALLQVDPDFRDSLKRAGLLTRDSRKVERKKPGLKKARKASQFSKR

SEQ ID NO: 3347 - protein, 79 aa, Streptococcus pneumoniae
  misc_feature (B) LOCATION 1...79
  hypothetical: YES
LLKQKKAGFNIKMVDIAGAQLADRVIAEKNNAVADMVFGIGAVDSNKIRDQKLLVQYKPKWLDKIDQSLSDNEIIIIIL

SEQ ID NO: 3348 - protein, 291 aa, Streptococcus pneumoniae
  misc_feature (B) LOCATION 1...291
  hypothetical: YES
MKKQEKLALVESALEDFYGDQQFASSLRESVLYSIHAGGKRIRPFLLLEVLEALQVTIKPAHAQVATALEMIHTGSLIHDDLPAMDDDDYRRGRLTNHKKFGEAMAILAGDALFLDSYALIAQADLPSQIKVDLIANLSLASGSLGMVAGQVLDMEGEHQHLSLEELQTIHANKTGKLLAYPFQAAAIIAELSPEMQVKLKTVGELIGLAFQVRDDVLDVTASFEEIGKTPQKDLQAEKSTYPALLGLEESIAFCNQTLDQANEKLEEIAQQIPFETESIVSVVESLRING

SEQ ID NO: 3349 - protein, 426 aa, Streptococcus pneumoniae
  misc_feature (B) LOCATION 1...426
  hypothetical: YES
RRKQMLLIKNGRVMDPKSGLDQVCDVLVQDGKIIKIAPEITEEGAETIDATGLVVAPGLVDIHVHFREPGQTHKEDIHTGALAAAAGGFTTVVMMANTSPTISDVETLQAVLQSAAKEKINVKTVATITKNFNGKNLTDFKALLEAGAVGFSDDGIPLESSKIVKEAMEEAKKLNTFISLHEEDPGLNGVLGFNENIAREHFHICGATGVAEYAMMARDVMIAYATKAHVHIQHLSKEESVKVVEFAQGLGAEVTAEVAPQHFSKTEALLLTQGSNAKMNPPLRLESDRRAVIEGLKSGVITVIATDHAPHHVDEKNVEDITKAPSGMTGLETSLSLGLTYLVEAGELSLMELLEKMTYNPAKLYNFEAGYLAENGPADITIFDAKADRLVDSHFASKAANSPFIGETLKGQVKYTICKGQIVYQA

SEQ ID NO: 3350 - protein, 277 aa, Streptococcus pneumoniae
  misc_feature (B) LOCATION 1...277
  hypothetical: YES
RRKHTMTGSNKLTKRDYLKTSLRAFFCQNGFNYSNYQGLGYANVMYPALKKHYGEDQEGFYQALEENCEFYNTNPHFLPFITSLHLVMLENGRPAKETRSIKMALMGPLAGIGDSLSQFCLAPLFSTIAASFAQKSLVVGPILFFLAMNTILTAIKLSTGLYGYKLGTTVIDKLSEQMATISRIANIIGVTVIAGLAGTSVKIMVPITFAAGEVKADAKQSIVSIQGMLDKVAPALLPALFTLLVYYLIKEKKWTTYKLVILTVIIGIIGSWLKIIA

SEQ ID NO: 3351 - protein, 515 aa, Streptococcus pneumoniae
  misc_feature (B) LOCATION 1...515
  hypothetical: YES
KEEHMAHENVIEMRDITKVFGGFVANDKINLHLRKGEIHALLGENGAGKSTLMNMLAGLLEPTSGEIAVNGQVVNLDSPSKAASLGIGMVHQHFMLVEAFTVAENIILGSELTKNGVLDIAGASKEIKALSERYGLAVDPSAKVADISVGAQQRVEILKTLYRGADILIFDEPTAVLTPSEIDELMAIMKNLVKEGKSIILITHKLDEIRAVSDRVTVIRRGKSIETVEIAGATNADLAEMMVGRSVSFKTEKQASKPKEVVLSIKDLVVNENRGVPAVKNLSLDVRAGEIVGIAGIDGNGQSELIQAITGLRKVESGSIELKGDSIVGLHPRQITELSVGHVPEDRHRDGLILEMMISENIALQTYYKEPHSKNGILNYSNITSYAKKLMEEFDVRAASELVPAAALSGGNQQKAIIAREIDRDPDLLIVSQPTRGLDVGAIEYIHKRLIEERDNGKAVLVVSFELDEILNVSDRIAVIHDGKIQGIVSPETTNKQGLGVLMAGGNLGKEKSDV

SEQ ID NO: 3352 - protein, 115 aa, Streptococcus pneumoniae
  misc_feature (B) LOCATION 1...115
  hypothetical: YES
LEWHLKKLLLWGFFPLSFQTLANFWLLVLLAVPYFNALKIRLTLLTKKGYRVIMTQYPFFYFENLYSMKIKEQTRKLAAGCSKHCFEVVDETDEVSNHTYGKAKLMRFEEIFEEY

SEQ ID NO: 3353 - protein, 477 aa, Streptococcus pneumoniae
  misc_feature (B) LOCATION 1...477
  hypothetical: YES
SGWQACSQWYPYFCNWELRRFSMFRKILIANRGEIAVRIIRAARELGIATVAVYSTADKEALHTLLADEAVCIGPGKATESYLNINAVLSAAVLTEAEAIHPGFGFLSENSKFATMCEEIGIKFIGPSGHVMDMMGDKINARAQMIKAGVPVIPGSDGEVHNSEEALIVAEKIGYPVMLKASAGGGGKGIRKVEKPDDLVSAFETASSEAKANYGNGAMYIERVIYPARHIEVQILGDEHGHVIHLGERDCSLQRNNQKVLEESPSIAIGKTLRHEIGAAAVRAAEFVGYENAGTIEFLLDEASSNFYFMEMNTRVQVEHPVTEFVSGVDIVKEQICIAAGQPLSVKQEDIVLRGHAIECRINAENPAFNFAPSPGKITNLYLPSGGVGLRVDSAVYPGYTIPPYYDSMIAKIIVHGENRFDALMKMQRALYELEIEGVQTNADFQLDLISDRNVIAGDYDTCFLMETFLPKYQEKE

SEQ ID NO: 3354 - protein, 487 aa, Streptococcus pneumoniae
  misc_feature (B) LOCATION 1...487
  hypothetical: YES
LRWHREFRPHASYFAWGFFIQSLRTRIRTEREITMERIIHGDVLSPILAYMRLKGQHKVILESIPRDKETARFSILAYNPVFEIKFENGVLYQNGQVIDRDPLDFLYEVIHKSQHHSELPFGGGAIGFVGYDMISLYEEIGQIPEDTIGTPDMHFFVYESYIVFDHKKEKIHVIEDALYSERSQEALEKSLNQVLEELRIPAPNEFEDLDLSPLDFKPHIAPHKFEGMVETARDLIRNGDMFQCVLSQRFSAEVTGNPFDFYRNLRVTNPSNYLYFYDFGDYQIIGASPESLVSVKNGIVTTNPIAGTRPRGATDEEDKALATDLLSDEKETAEHRMLVDLGRNDIGRISETASVQVTKYMEVELFRYVMHLTSVVKGRLLAELTAMDALKATLPAGTVSGAPKIRAMRRIYELETEKRGVYAGAIGYLSATGDMDLAIAIRTMILKNQRAYVQAGAGIVYDSIAQNEYQETINKAKSMTRIGELRP

SEQ ID NO: 3355 - protein, 117 aa, Streptococcus pneumoniae
  misc_feature (B) LOCATION 1...117
  hypothetical: YES
QGWQVMFLKQSRLKPYPMRRFEKTVTEEGVAKEGYAKEAETVRLELWPASSKLQSELYGERVNDILNANANKSATIKVKDGVCIDSQTEVTHRVISKKVYTHHQVLELERVRATRGR

SEQ ID NO: 3356 - protein, 237 aa, Streptococcus pneumoniae
  misc_feature (B) LOCATION 1...237
  hypothetical: YES
KSRHRIMPTFSSNAPFNPNPISKILVVFITGLTVMHSINIRFELAIVCLIGILLYLNGYKKTLFKWIILCGILYSLPNFMVLSELNPIVKMFLSIPIVIRMFILPFMAASFMIKTSDVGAIISSMDKLKISKNVSIPIAVMFRFFPSFKEEKKNIKMAMRVRGINFKNPVKYLEYVSVPLLIISSNISDDIAKAAETKAIENPIAKTRYIRVKIQLIDFVYVLAVAGLIVGGLIWLK

SEQ ID NO: 3357 - protein, 313 aa, Streptococcus pneumoniae
  misc_feature (B) LOCATION 1...313
  hypothetical: YES
ERRQIMSTIDKEKFQFVKRDDFASETIDAPAYSYWKSVFKQFMKKKSTVVMLGILVAIILISFIYPMFSKFDFNDVSKVNDFSVRYIKPNAEHWFGTDSNGKSLFDGVWFGARNSILISVIATVINLVIGVFVGGIWGISKSVDRVMMEVYNVISNIPPLLIVIVLTYSIGAGFWNLIFAMSVTTWIGIAFMIRVQILRYRDLEYNLASRTLGTPTLKIVAKNIMPQLVSVIVTTMTQMLPSFISYEAFLSFFGLGLPITVPSLGRLISDYSQNVTTNAYLFWIPLTTLVLVSLSLFVVGQNLADASDPRTHR

SEQ ID NO: 3358 - protein, 129 aa, Streptococcus pneumoniae
  misc_feature (B) LOCATION 1...129
  hypothetical: YES
ETGQRVVKSKNAYYQVLKKLDTMRFIVGRFTSFSTEIESFPKIFLYSMKIKVQTRKLAAGCSKHCFEVVDRTDEVSSKHGFEVVDETDEVSSKHGFEVADETDEVSSKHGFEVADRTDEVSNIYTVRRR

SEQ ID NO: 3359 - protein, 321 aa, Streptococcus pneumoniae
  misc_feature (B) LOCATION 1...321
  hypothetical: YES
NKGQSPNKLEDLMKKLGTLLVLFLSAIILVACASGKKATTSGQKLKVVATNSIIADITKNIAGDKIDLHSIVPIGQDPHEYEPLPEDVKKTSEADLIFYNGINLETGGNAWFTKLVENAKKTENKDYFAVSDGVDVIYLEGQNEKGKEDPHAWLNLENGIIFAKNIAKQLSAKDPNNKEFYEKNLKEYTDKLDKLDKESKDKFNKIPAEKKLIVTSEGAFKYFSKAYGVPSAYIWEINTEEEGTPEQIKTLVEKLRQTKVPSLFVESSVDDRPMKTVSQDTNIPIYAQIFTDSIAEQGKEGDSYYSMMKYNLDKIAEGLAK

SEQ ID NO: 3360 - protein, 246 aa, Streptococcus pneumoniae
  misc_feature (B) LOCATION 1...246
  hypothetical: YES
MAFNPIVKYSLALVYDLRKNLKGLTVLSLLITGLFFLTKYPLENEITMLDVGQGESIFLRDVTGKTILIDVGGKAESYKKIEKWQEKMTTSNAQRTLIPYLKSRGVAKIDQLILTNTDKEHVGDLSEVTKAFHVGEILVSKGSLKQKQFVVELQATKTKVRSMTVGENLPIFGSQLEVLSPRKMGDGGHDDTLVLYGKFLDKQFLFTGNLEEKGEKDLLKHYPDLKVYVLKASQHGNKKSSSPAFX

SEQ ID NO: 3361 - protein, 300 aa, Streptococcus pneumoniae
  misc_feature (B) LOCATION 1...300
  hypothetical: YES
NDFKSLNRKGESMALFSKKDKYIRINPNRSVREKPQAKPEVPDELFSQCPGCKHTIYQKDLGSERICPHCSYTFRISAQERLALTIDMGTFKELFTGIESKDPLHFPGYQKKLASMREKTGLHEAVVTGTALIKGQTVALGIMDSNFIMASMGTVVGEKITRLFEYATVEKLPVVLFTASGGARMQEGIMSLMQMAKISAAVKRHSNAGLFYLTILTDPTTGGVTASFAMEGDIILAEPQSLVGFAGRRVIENTVRESLPEDFQKAEFLLEHGFVDAIVKRRDLPDTIASLVRLHGGSPR

SEQ ID NO: 3362 - protein, 75 aa, Streptococcus pneumoniae
  misc_feature (B) LOCATION 1...75
  hypothetical: YES
DGFKFAWKMDILTSLQESESLISIQNWHNSCMNGNINPSQDALVLKIIEALIVKEELSYEARTACIHFLLKILNI

SEQ ID NO: 3363 - protein, 205 aa, Streptococcus pneumoniae
  misc_feature (B) LOCATION 1...205
  hypothetical: YES
IMFKRIRRVLVLAVFLFAGYKAYRVHQDVKQVMTYQPMVREILSEKDTPANEELVLAMIYTETKGKEGDVMQSSESASGSTNTINDNASSIRQGIQTLTGNLYLAQKKGVDIWTAVQAYNFGPAYIDFIAQNGKENTLALAKQYSRETVAPLLGNTTGKTYSYIHPISIFHGAELYVNGGNYYYSRQVRLNLYIIKCFTLFSTSG

SEQ ID NO: 3364 - protein, 118 aa, Streptococcus pneumoniae
  misc_feature (B) LOCATION 1...118
  hypothetical: YES
QNFLTWSIKPMCMSILFAWFRKNALRVSQQYVMSQTVKVFDLLLKSSATPQPMLFSYNLFKMTQMQTNFGFNMLAIQNGIPKILSLRQILDAYIEHQKEWLFVVHVLIRKKRKRALIS

SEQ ID NO: 3365 - protein, 202 aa, Streptococcus pneumoniae
  misc_feature (B) LOCATION 1...202
  hypothetical: YES
RDFLSNLLKGFSLGLALFLLTLLGLVVLGQYRLESIHLNPYSLAFVVFTIPFWILQGTAEEVVARAWLLPQLASRTNLKLAILISSLFFTLLHMGNSGLTPLSLVNLFLFGVAMALYLLKTDTVWGVAGIHGAWNFAQGNLFGILVSGQPSGTSLMTFLPQGNQDWLSGGSFGIEGSIMTSLVLLLLIVYLANKLKKENERM

SEQ ID NO: 3366 - protein, 79 aa, Streptococcus pneumoniae
  misc_feature (B) LOCATION 1...79
  hypothetical: YES
MNIKIIRRTKVVKNLKLKLARVELDLTQGQLADAVGVTRQTIGLIEAGKYNPSLSLCQSICRCLGKTLDQLFWEEEDEK

SEQ ID NO: 3367 - protein, 73 aa, Streptococcus pneumoniae
  misc_feature (B) LOCATION 1...73
  hypothetical: YES
SICLHLISIYYIISINDDGDCFVCACRFLNPDRAEEYFCRGCQGENPEDIEFYDEQLQAEKVEVLNIRLEVKN

SEQ ID NO: 3368 - protein, 546 aa, Streptococcus pneumoniae
  misc_feature (B) LOCATION 1...546
  hypothetical: YES
RSIKMKKIVKLALTAAAVLIAVVGLVACSSGSKKSDFSESGKEKVFYLSGLLQGTGDRIPYVWQNGDGLVPYLLYRTLLMADSKYEKSTPDLAKDWKKSDDEKTYEFTLKDGLKWSDGEALTASDVEFSVKLALKASVINGIFPSTFTKIEGAKDFKDDKADKISGLTVDGNKVTFKLTAPVGDFEQMMTQFFILPKHKLESENPLELNNSSFWTAPVTSGMYKVKEISAGNFLEYDKNENYENEKPKFDKVVFNYISDPVLALQDGKSYFYSTNKPQEISQLDAVSTLTKKPIDILFYRYFIANLAGVEGNGDSLIANPKVREAILYAINRDELAKSVFSGIADVNNTGVPSSLEAHLKSANKFEYNPEKAKQLLKEAKYDNSRNLILAYYYKDQASQDFMQAVSYQLNEVGIKNEVVQITSDATTGLFKTRKYDLAYKGLSSFGYETWYGEYSSTNTNFKNITNGETSFDELSKKLSETSDVKERNKILASLQKLEQEKLLKLNLFTFKNFLYLNTEKVLIPDDVQFGNPFYKFDYKFEKWDAK

SEQ ID NO: 3369 - protein, 75 aa, Streptococcus pneumoniae
  misc_feature (B) LOCATION 1...75
  hypothetical: YES
IPIKDIDFSIVNQMNDLVSLTIVALRSFKTELIFLWGIEQVLHELIDSINPCRPSVHRSQNLDITGRNTISEGGT

SEQ ID NO: 3370 - protein, 295 aa, Streptococcus pneumoniae
  misc_feature (B) LOCATION 1...295
  hypothetical: YES
MEIKIETGGLRLDKALSDLSELSRSLANEQIKSGQVLVNGQVKKAKYTVQEGDVVTYHVPEPEVLEYVAEDLPLEIVYQDEDVAVVNKPQGMVVHPSAGHTSGTLVNALMYHIKDLSGINGVLRPGIVHRIDKDTSGLLMIAKNDDAHLALAQELKDKKSLRKYWAIVHGNLPNDRGVIEAPIGRSEKDRKKQAVTAKGKPAVTRFHVLERFGDYSLVELQLETGRTHQIRVHMAYIGHSVAGDEVYGPRKTLKGHGQFLHAKTLGFTHPRTGKTLEFKADIPEIFKETLERLRK

SEQ ID NO: 3371 - protein, 448 aa, Streptococcus pneumoniae
  misc_feature (B) LOCATION 1...448
  hypothetical: YES
FMIKIYDTMSRDLREFVPIEDGKIKMYVCGPTVYNYIHVGNARSTVAFDTIRRYFEYRGYKVAYISNFTDVDDKIINRAREEGITPQEVADKYIAAFREDVTALGVKPATRHPRVVEFMADIIRFVEDLIEKGFAYESQGDVYFRVEKSHNYAKLANKTLEDLELGASGRTDEETARKENPVDFALWKSSKPGEISWDSPWGPGRPGWHIECSVMSTEILGDTIDIHGGGADLEFPHHTNEIAQSEAKTGKAFANYWMHNGFVNIDNVKMSKSLGNFITVHDALKTLDGQVLRFFFATQHYRKPINFTEKAVRDAETNLKYLKNTYEQPFTGNVDAQELQNFKDKFVAAMDEDFNAANGITVVFEMAKWINSGNYDASVKQALADMLEIFGIVFVEEVLDAEIEDLIQKRQEARANRDFATADQIRDQLVTQGIKLLDTKDGVRWTRD

SEQ ID NO: 3372 - protein, 157 aa, Streptococcus pneumoniae
  misc_feature (B) LOCATION 1...157
  hypothetical: YES
TMINNVVLVGRMTRDAELRYTPSNVAVATFTLAVNRTFKSQNGEREADFINVVMWRQQAENLANWAKKGSLIGVTGRIQTRSYDNQQGQRVYVTEVVAENFQMLESRSVREGHTGGAYSAPTANYSAPTNSVPDFSRNENPFGATNPLDISDDDLPF

SEQ ID NO: 3373 - protein, 523 aa, Streptococcus pneumoniae
  misc_feature (B) LOCATION 1...523
  hypothetical: YES
LMIKKENIMTKRVLISVSDKAGIVEFAQELKKLGWEIISTGGTKVALDNAGVDTIAIDDVTGFPEMMDGRVKTLHPNIHGGLLARRDLDSHLEAAKDNKIELIDLVVVNLYPFKETILKPDVTYADAVENIDIGGPSMLRSAAKNHASVTVVVDPADYAVVLDELAANGETSYETRQRLAAKVFRHTAAYDALIAEYFTAQVGESKPEKLTLTYDLKQPMRYGENPQQDADFYQKALPTDYSIASAKQLNGKELSFNNIRDADAAIRIIRDFKDSPTVVALKHMNPCGIGQADDIETAWDYAYESDPVSIFGGIVVLNREVDAATAEKMHGVFLEIIIAPSYTDEALAILINKKKNLRILALPFNAQEASEVEAEYTGVVGGLLVQNQDVVKESPADWQVVTKRQPTETEATALEFAWKAIKYVKSNGIIVTNDHMTLGVGPGQTNRVASVRLAIDQAKDRLDGAVLASDAFFPFADNVEEIAKAGIKAIIQPGGSVRDQESIEAADKYGLTMVFTGVRHFRH

SEQ ID NO: 3374 - protein, 275 aa, Streptococcus pneumoniae
  misc_feature (B) LOCATION 1...275
  hypothetical: YES
MMIKVIATDMDGTLLDARGQLDLPRLEKILDQLDQRGIRFVIATGNEIHRMRQLLSPLVDRVVLVVANGARIFENNELIQAQTWDDAIVNKALAHFKGRACQNQFVVTGMKGDFVKEGTIFTDLESFMTPEMIEKFYQRMQFVDELTSDLFGGVLKMSMVVGEERLSSVLEEINALFDGRVRAVSSGYGCIDILQAGIHKAWGLEELLKRWDLKSQEIMAFGDSENDVEMLEMAGIAYAMENADEKAKAVATALAPANSQGGVYQVLENWLEKGE

SEQ ID NO: 3375 - protein, 751 aa, Streptococcus pneumoniae
  misc_feature (B) LOCATION 1...751
  hypothetical: YES
ARIKMNTLLTLRGKSFTQKSRNNGMGPITIPKKTIITLEHLKYLHFSLEETKTYWEKNNIIDGILISIYYNRIVAKSNRINGYFNVGGGNPFPNDTIVGAKFNDEKTKHIVTHYISRDALNKTITVLSKIIEVFEEHFDRAITCEMFSDSSTFASINFSEYGISKSKFQQYLRDSCFIENFGVEHTTVSDIQNSIVTFYDVHTDIFRLLNKLNIDISEANIMNQTTVLLDEKNIELLLSKAPYLVSMIVEDFSKLSVDDFSLDNNDLKINLPSPMNEPVVGVIDTLFDKRVYFNEWVEYHDFVSPDISKDSQDYKHGTAVTSLIVDGANLNPNLDDGCGNFRVRHFGVSLQSGFNSFTIIKQIKEIVSQNADIKVWNLSLGSNDEIRENFISAEGALLDEIQFENDVIFIIAGTNASVINGKRKRIGAPADSLNSIIVNSVDFNNQSVSYSREGIVLSFFVKPDVSYYGGGNGDFINVCEPLGLGRVAGTSFAAPFIARKMAYLIHIMGLSREEAKALLIDAAIPWNDKKTFTDLSLIGNGIVPIKMDDILSTPDDEIKFIVSDISRAYDTYNYDFPVPISSESYPYVAKATMCYFPNCSRKQGVDYTNTEMQLTFGRLKSDGIKSINKDNQHAEDSPGYVRENAARNIFRKWDNVKHIGESFTSRKRAKAILNPSNPQWGMSIKTIERLKSGDGQGVRFGVVVTLKELNGVNRIEDFIQQAELRGWLVNRLQVEAQVDLFNSLNEEIEFE

SEQ ID NO: 3376 - protein, 106 aa, Streptococcus pneumoniae
  misc_feature (B) LOCATION 1...106
  hypothetical: YES
NVVKSTFFIFIFGIPLHSFAKKGVTNRPYFKKRIEKRIQHLSHPKNNLFSTEDMGFEPTHAITRLPRFQHGLLSLLSNLPILTQIVYHKGSYLAIKILEIRKNDRF

SEQ ID NO: 3377 - protein, 789 aa, Streptococcus pneumoniae
  misc_feature (B) LOCATION 1...789
  hypothetical: YES
NSVKKNDIIEFMDKNKIMGLTQREVKERQAEGLVNDFTASASTSTWQIVKRNVFTLFNALNLAIALALAFVQAWSNLVFFAVICFNAFSGIVTELRAKHMVDKLNLMTKEKVKTIRDGQEVALNPEELVLGDVIRLSAGEQIPSDALVLEGFAEVNEAMLTGESDLVQKEVDGLLLSGSFLASGSVLSQVHHVGADNYAAKLMLEAKTVKPINSRIMKSLDKLAGFTGKIIIPFGLALLLEALLLKGLPLKSSVVNSSTALLGMLPKGIALLTITSLLTAVIKLGLKKVLVQEMYSVETLARVDMLCLDKTGTITQGKMQVEAVLPLTETYGEEAIASILTSYMAHSEDKNPTAQAIRQRFVGDVAYPMISNLPFSSDRKWGAMELEGLGTVFLGAPEMLLDSEVPEAREALERGSRVLVLALSQEKLDHHKPQKPSDIQALALLEILDPIREGAAETLDYLRSQEVGLKIISGDNPVTVSSIAQKAGFADYHSYVDCSKITDEELMAMAEETAIFGRVSPHQKKLIIQTLKKAGHTTAMTGDGVNDILALREADCSIVMAEGDPATRQIANLVLLNSDFNDVPEILFEGRRVVNNIAHIAPIFLIKTIYSFLLAVICIASALLGRSEWILIFPFIPIQITMIDQFVEGFPPFVLTFERNIKPVEQNFLRKSMLRALPSALMVVFSVLFVKMFGASQGWSELEISTLLYYLLGSIGFLSVFRACMPFTLWRVLLIVWSVGGFLATALFPRIQKLLEISTLTEQTLPVYGVMMLVFTVIFILTSRYQAKK

SEQ ID NO: 3378 - protein, 156 aa, Streptococcus pneumoniae
  misc_feature (B) LOCATION 1...156
  hypothetical: YES
SLVKVRRNLIDSLIQYMLIIGVNNSGGSCRLREFGEKIKRLRLAKKISRSEFCGDESELSIRQLIRIENGESRPTLTKLKYIAERLGVEDYKLMPSYIELDKEYLELKYFLMRTPTYEDETIAQKKESVLIRFLKSIMIGYLRKKDLSSQIIHIWH

SEQ ID NO: 3379 - protein, 189 aa, Streptococcus pneumoniae
  misc_feature (B) LOCATION 1...189
  hypothetical: YES
TIVKEVFPMIKQIKAHLNKSIQSIIGQKVEFVKQDEQAFTRKRRLSLETMIRTILGMGGKSLSKELLDARLTVSNSAFVQRRYQIKPEAFYALFKEFTAPIPLNTDFPIFAADGSDICIPRNPMDTETSIQTQTDVKSYNLIHINALYDLTTGVYRDVSIQDKHAQHERLALIQMMEASPFRESSCYHG

SEQ ID NO: 3380 - protein, 189 aa, Streptococcus pneumoniae; identical to SEQ ID NO: 3379
  misc_feature (B) LOCATION 1...189
  hypothetical: YES

SEQ ID NO: 3381 - protein, 189 aa, Streptococcus pneumoniae; identical to SEQ ID NO: 3379
  misc_feature (B) LOCATION 1...189
  hypothetical: YES

SEQ ID NO: 3382 - protein, 687 aa, Streptococcus pneumoniae
  misc_feature (B) LOCATION 1...687
  hypothetical: YES
STVKKNLVIVESPAKAKTIEKYLGRNYKVLASVGHIRDLKKSSMSVDIENNYEPQYINIRGKGPLINDLKKEAKKANKVFLASDPDREGEAISWHLAHILNLDENDANRVVFNEITKDAVKNAFKEPRKIDMDLVDAQQARRILDRLVGYSISPILWKKVKKGLSAGRVQSIALKLIIDRENEINAFQPEEYWTVDAVFKKGTKQFHASFYGVDGKKMKLTSNDEVKEVLSRLTSKDFSVDQVDKKERKRNAPLPYTTSSMQMDAANKINFRTRKTMMVAQQLYEGINIGSGVQGLITYMRTDSTRISPVAQNEAASFITDRFGSKYSKHGSKVKNASGAQDAHEAIRPSSVFNTPESIAKYLDKDQLKLYTLIWNRFVASQMTAAVFDTMAVKLSQTGVQFAANGSQVKFDGYLAIYNDSDKNKMLPTWCWRCVPQVNSKPEQHFTQPPARYSEATLIKTLEENGVGRPSTYAPTIETIQKRYYVRLAAKRFEPTELGEIVNKLIVEYFPDIVNVTFTAEMEGKLDDVEVGKEQWRRVIDAFYKPFSKEVAKAEEEMEKIQIKDEPAGFDCEVCGSPMVIKLGRFGKFYACSNFPDCRHTQAIVKEIGVECPSCHQGQIIERKTKRNRLFYGCNRYPECEFTSWDKPVGRDCPKCGNFLMEKKVRGGGKQVVCSKGDDSSPRVXXT

SEQ ID NO: 3383 - protein, 214 aa, Streptococcus pneumoniae
  misc_feature (B) LOCATION 1...214
  hypothetical: YES
REVNMIELKQVSKSFGERELFSNLSMTFEAGKVYALIGSSGSGKTTLMNMIGKLEPYDGTIFYRGKDLANYKSSDFFRHELGYLFQNFGLIENQSIEENLKLGLTGQKLSRSEQRLRQKQALEQVGLAYLDLDKRIFELSGGESQRVALAKVILKNPPFILADEPTASIDPATSQLIMEILLSLRDDNRLIIIATHNPAIWEMADEVFTMDRLK

SEQ ID NO: 3384 - protein, 199 aa, Streptococcus pneumoniae
  misc_feature (B) LOCATION 1...199
  hypothetical: YES
FGVKYLQRMIALTDTGLTFTKDPFDCERYEDLRSLLSEMLNQGSDLDAEEVAEVLKPTSAYATPLMDVRAWIVEDEKICLVRGQGEDSWALPGGFGEVGYSPTENILKEIEEETGFKAKVERLLAVFDTNRFQLQSKQYAKFVFECKLLDGQFQENQEIADLQFFAIDQLPNLSEKRITKEQIEILWQVYQGQREQYLD

SEQ ID NO: 3385 - protein, 121 aa, Streptococcus pneumoniae
  misc_feature (B) LOCATION 1...121
  hypothetical: YES
INSKELSISMLKKYPCTMQHDQSDCAAAVVSTVLLSYKKELSIMKIREIIGTDMYGTTVSGIVSGLNKLNFTVKAVRVALEDLTPKLTFPAILQVKNDLGQNHFVVLHSIKEKIKGTRITK

SEQ ID NO: 3386 - protein, 76 aa, Streptococcus pneumoniae
  misc_feature (B) LOCATION 1...76
  hypothetical: YES
AFSKENLYSMKIKEQTRKLTAGCSKHCFEVVDETDEVSSKHGFEVVDETDEVSSKHRFEVADRTDEVSNIYTVRRR

SEQ ID NO: 3387 - protein, 130 aa, Streptococcus pneumoniae
  misc_feature (B) LOCATION 1...130
  hypothetical: YES
SSSKLVFLKLKDDFGGYKMTLTIHVYYKGDGDSAIKFAREMLDSGLVEEIRNQKGNLKYEYFLPIEKEGTILLIDQWINQETLDKHYQSKTMQKILDLRKKYHLQMQVERYIEDDSGMPESDKSFIDTGN

SEQ ID NO: 3388 - protein, 495 aa, Streptococcus pneumoniae
  misc_feature (B) LOCATION 1...495
  hypothetical: YES
MSSKVIVTIFGASGDLAKRKLYPSLFRLYQSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFGAKWTWQPDIAYRQDGRFE

SEQ ID NO: 3389 - protein, 354 aa, Streptococcus pneumoniae
  misc_feature (B) LOCATION 1...354
  hypothetical: YES
FTCFCDIIVLSLHRGIVMKETVYFGTYTRRTSQGIYKADFDTETGQLSNLELFAAEPSPTYLAFDQHQHLYTVGSQDDKGGIAAYQTDGTVLNHVVEEGAPHCYVAVDEKRDLVYAANYHKGQVLVYKRQEDGSLLLSDMDQHSGQGPHENQASPHVHYTDLTPDHYLVTCDLGTDQVITYDLDQEGKLSKLYTYHSKPGAGSRHIIFHNHYKIAYLICELNSTIEVLIYDGVGEFERMQVISTLPEAYEGFNGTAAIHLSKDGKYLYASNRGHDSIAVYTILADGSLELLEIVPTHGQTPRDFDLTPDQKFLIVVHQDSDNATVFKRNCDNGRLAELSNDFHVPEAVCIRFAP

SEQ ID NO: 3390 - protein, 361 aa, Streptococcus pneumoniae
  misc_feature (B) LOCATION 1...361
  hypothetical: YES
HMSKLQQILTYLESEKLDVAVVSDPVTINYLTDFYSDPHERQMFLFVLADQEPLLFVPALEVERASSTVSFPVVGYVDSENPWQKIKHALPQLDFKRVAVEFDNLILTKYHGLKTVFETAEFDNLTPRIQRMRLIKSADEVQKMMVAGLYADKAVHVGFDNISLDKTETDIIAQIDFAMKREGYEMSFDTMVLTGDNAANPHGIPAANKVENDALLLFDLGVLVNGYASDMTRTVAVGKPDQFKKDIYNLTLEAQQAALDFIKPGVTAHEVDRAAREVIEKAGYGEYFNHRLGHGIGMDVHEFPSIMEGNDMVIEEGMCFSVEPGIYIPGKVGVRIEDCGVVTKDGFDLFTSTSKDLLYFD

SEQ ID NO: 3391 - protein, 225 aa, Streptococcus pneumoniae
  misc_feature (B) LOCATION 1...225
  hypothetical: YES
MMSNKNKGILIFAILYTVLFVFDGVKLLASLMPSVIANYLVYVVLALYGSFLFKDRLIQQWKEIRKTKRKFFFGVLTGWLFLILMTVVFEFVSEMLKQFVRLDGQGLNQSNIQSTFQEQPLLIAVFACVIGPLVEELFFRQVLLHYLQERLPGLLSIILVGLVFALTHMHSLALSEWIGAVGYLGGGLAFSIIYVKEKENIYYPLLVHMLSNSLSLIILAISIVK

SEQ ID NO: 3392 - protein, 114 aa, Streptococcus pneumoniae
  misc_feature (B) LOCATION 1...114
  hypothetical: YES
AWSNKAMAYNTDFKQGALDSIKGGHRHVEAAKVFWCWRQNSLHVGKERREQRNLERKKRVVKKRKIPLEELKAFVEAHPDAFLREIAAHFDCAVPSVWAALKQIKVTLKKDDDL

SEQ ID NO: 3393 - protein, 274 aa, Streptococcus pneumoniae
  misc_feature (B) LOCATION 1...274
  hypothetical: YES
PLPKGEAMSTYNWDEKHILTFPEEKVALSTKDVHVYYGKNESIKGIDMQFERNKITALIGPSGSGKSTYLRSLNRMNDTIDIAKVTGQILYRGIDVNRPEINVYEMRKHIGMVFQRPNPFAKSIYRNITFAHERAGVKDKQVLDEIVETSLRQAALWDQVKDDLHKSALTLSGGQQQRLCIARAISVKPDILLMDEPASALDPIATMQLEETMFELKKNFTIIIVTHNMQQAARASDYTGFFYLGDLIEYDKTATIFQNAKLQSTNDYVSGHFG

SEQ ID NO: 3394 - protein, 321 aa, Streptococcus pneumoniae
  misc_feature (B) LOCATION 1...321
  hypothetical: YES
IMPKKILVLHTGGTISMQADASGAVVTSSDNPMNHVSNPLEGIQVHALDFFNLPSPHIKPKHMLVLYQKIKEEADNYDGVVITHGTDTLEETAYFLDTMEVPHMPIVLTGAMRSSNELGSDGVYNYLSALRVASDDRAADKGVLVVMNDEIHAAKYVTKTHTTNVNTFQTPTHGPLGLIMKQEILYFKTAEPRVRFDLDHIQGLVPIISAYAGMTDELIDMLDLEHLDGLIIQAFGAGNIPKETAQKLESLLQKGIPVALVSRCFNGIAEPVYAYQGGGVQLQKAGVFFVKELNAQKARLKLLIALNAGLTGQALKDYMEG

SEQ ID NO: 3395 - protein, 431 aa, Streptococcus pneumoniae
  misc_feature (B) LOCATION 1...431
  hypothetical: YES
KAPKQLIRKYLMEHINHTTLLIGIKDKNITLNKAIQHDTHIEVFATLDYHPPKCKHCKGKQIKYDFQKPSKIPFIEIGGFPSLIHLKKRRFQCKSCRKVTVAETTLVQKNCQISEMVRQKIAQLLLNREALTHIASKLAISTSTSTVYRKLKQFHFQEDYTTLPEILSWDEFSYQKGKLAFIAQDFNTKKIMTILDNRRQTTIRNHFFKYSKEARKKVKVVTVDMSGSYIPLIKKLFPNAKIVLDRFHIVQHMSRALNQTRINIMKQFDDKSLEYRALKYYWKFILKDSRKLSLKPFYARTFRETLTPRECLKKIFTLVPELKDYYDLYQLLLFHLQEKNTDQFWGLIQDTLPHLNRTFKTTLSTFICYKNYITNAIELPYSNAKLEATNKLIKDIKRNAFGFRNFENFKKRIFIALNIKKERTKFVLSRA

SEQ ID NO: 3396 - protein, 169 aa, Streptococcus pneumoniae
  misc_feature (B) LOCATION 1...169
  hypothetical: YES
TYTKTYKGGKLMTIVGCRIDGRLIHGQVANLWAGKLNVSRIMVVDDEVVNNDIEKSGLKLATPPGVKLSILPVEKAAANILAGKYDSQRLFIVARKPDRFLGLVEAGVPLETLNVGNMSQTPETRSITRSINVVDKDVEDFHKLAEKGVKLTAQMVPNDPISDFLSLLK

SEQ ID NO: 3397 - protein, 307 aa, Streptococcus pneumoniae
  misc_feature (B) LOCATION 1...307
  hypothetical: YES
EMTKTAFLFAGQGAQYLGMGRDFYDQYPIVKETIDRASQVLGYDLRYLIDTEEDKLNQTRYTQPAILATSVAIYRLLQEKGYQPDMVAGLSLGEYSALVASGALDFEDAVALVAKRGAYMEEAAPADSGKMVAVLNTPVEVIEEACQKASELGVVTPANYNTPAQIVIAGEVVAVDRAVELLQEAGAKRLIPLKVSGPFHTALLEPASQKLAETLAQVSFSDFTCPLVGNTEAAVMQKEDIAQLLTRQVKEPVRFYESIGVMQEAGISNFIEIGPGKVLSGFVKKIDQTAHLAHVEDQASLVALLEK

SEQ ID NO: 3398 - protein, 159 aa, Streptococcus pneumoniae
  misc_feature (B) LOCATION 1...159
  hypothetical: YES
FMAKVLLGFMGAGKSTIARGLDTNYLDMDALIEKRLGMSIANFFAEKGEETFRQVESEVLADLLQTDQVVSTGGGVVISQRNRDLLKTNTDNIYLKADFETLYQRIAADKDNQRPLFLNNSKEELVAIFQERQAWYEEVASRVLDVTKLSPEEIIEELR

SEQ ID NO: 3399 - protein, 158 aa, Streptococcus pneumoniae
  misc_feature (B) LOCATION 1...158
  hypothetical: YES
ARAKSVHWTDLLHQDSFKLCQKRFYQPTFRMHLTHREVRDKLLSYSEGLQVHYELYQLLLFHFQEKNADHFFGLIEQELPTVHPLFQTVFWTFLRDRDKIINALKLPYSNAKLEATNNLIKVIKCKAFGFRNFNNFKKRILMTLNIKKESTNFVLSRL

SEQ ID NO: 3400 - protein, 305 aa, Streptococcus pneumoniae
  misc_feature (B) LOCATION 1...305
  hypothetical: YES
IYYNKGMRNMKAKYAVWVAFFLNLTYAIVEFIAGGIFGSSAVLADSVHDLVDAIAIGISAFLETISNREEDNQYTLGYKRFSLLGALVTAVILVTGSVLVILENVTKILHPQPVNDEGILWLGIIAITINLLASLVVGKGKTKNESILNLHFLEDTLGWVAVILMAIVLRFTDWYILDPLLSLVISFFILSKALSRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 3401 - protein, 116 aa, Streptococcus pneumoniae
  misc_feature (B) LOCATION 1...116
  hypothetical: YES
RPYKIPYLETTGMPTRILLRKRRFKCYHCSKMMVAETSIVKKNHQIPRIINQKIAQKLIEKISMTDIAHQLAISTSTVIRKLNDFHFECNFRNLPKIMSWDVETVRGVTVSIGRWR

SEQ ID NO: 3402 - protein, 679 aa, Streptococcus pneumoniae
  misc_feature (B) LOCATION 1...679
  hypothetical: YES
KYYKYAKIGIAHGERILMINHITDNQFKLVSKYQPSGDQPQAIEQLVDNIEGGEKAQILMGATGTGKTYTMSQVISKVNKPTLVIAHNKTLAGQLYGEFKEFFPENAVEYFVSYYDYYQPEAYVPSSDTYIEKDSSVNDEIDKLRHSATSALLERNDVIVVASVSCIYGLGSPKEYADSVVSLRPGLEISRDKLLNDLVDIQFERNDIDFQRGRFRVRGDVVEIFPASRDEHAFRVEFFGDEIDRIREVEALTGQVLGEVDHLAIFPATHFVTNDDHMEVAIAKIQAELEEQLAVFEKEGKLLEAQRLKQRTEYDIEMLREMGYTNGVENYSRHMDGRSEGEPPYTLLDFFPDDFLIMIDESHMTIGQIKGMYNGDRSRKEMLVNYGFRLPSALDNRPLRREEFESHVHQIVYVSATPGDYENEQTETVIEQIIRPTGLLDPEVEVRPTMGQIDDLLGEINARVEKNERTFITTLTKKMAEDLTDYFKEMGIKVKYMHSDIKTLERTEIIRDLRLGVFDVLVGINLLREGIDVPEVSLVAILDADKEGFLRNERGLIQTIGRAARNSEGHVIMYADTVTQSMQRAIDETARRRKIQMAYNEEHGIVPQTIKKEIRDLIAVTKAVAKEEDKEVDINSLNKQERKELVKKLEKQMQEAVEVLDFELAAQIRDMMLEVKALD

SEQ ID NO: 3403 - protein, 92 aa, Streptococcus pneumoniae
  misc_feature (B) LOCATION 1...92
  hypothetical: YES
ICYNRTMEEEQLLKSGERINQLFSTDIKIIQNREVFSYSVDSVLLSRFPRFPKKGLIVDFCAGNGAVGLFASTRTQAQILSVEISGAFGGYG

SEQ ID NO: 3404 - protein, 532 aa, Streptococcus pneumoniae
  misc_feature (B) LOCATION 1...532
  hypothetical: YES
ICYNNVLAILTHSPLINLAFLALIVINLLVAYFQIGLLFIGARHLLYNEKRRLIEYIRKVFHESFGFMKKLTCAKALFIFFYIAMLFPFIRKMLKIYYLNKIVIPEFIQAYLEDRYWMWWLSILLLSLIFLYVSVRLMFALPKIVYDQLTVREAVMFSLEKTKKRVTFYAWNLFYILLKAHLLFYLPLIPLLLAQTLVDDITQRESLILGILNFVVIKNLYYMALTYSPVKFVSFLTGKELDMLPRREKDHIVRWGVMTCASLFFALEGYIYLEAPMVHLPQLISHRGVSNANGIQNTVESLETTAQLKPDLVETDVQETKDGQFVMMHDANLKNLAGINKSPQDLNLEELKGIDIFENGYQTKISSFEDYLSRANELGQKLLIEIKTSKKDSPDMMNRFLARYAAMLKIYGHQIQSLDYHVVEKVRQYDAELPVYFIMPYNSVFPKTRATGYTMEYSTLDEYFVSKLWTTDQKLYVWTVNDSEAISKSLHLGVDGVITDDLEKVQREIEVAQEDPEYTDLLLKKALEFFEF

SEQ ID NO: 3405 - protein, 241 aa, Streptococcus pneumoniae
  misc_feature (B) LOCATION 1...241
  hypothetical: YES
HSYNIKKGGTVMDAIFDLIGKVFNPILEMGGPVIMLIILTVLALLFGVKFSKALEGGIKLAIALTGIGAIIGMLNGAFSASLAKFVENTGIQLSITDVGWAPLATITWGSAWTLYFLLIMLIVNVVMLAMKKTDTLDVDIFDIWHLSITGLLIKWYADNNGVSQGVSLFIATAAIVLVGVLKIINSDLMKPTFDDLLNAPSSSPMTSTHMNYMMNPVIMVLDKIFEKSSQALIXMTLMLLN

SEQ ID NO: 3406 - protein, 145 aa, Streptococcus pneumoniae
  misc_feature (B) LOCATION 1...145
  hypothetical: YES
VKYNNKGVKTMTVINKFVLMEQAKKVLKNAYCPYSKFPVGAAILFKDGKVITGANIENVSFGVTNCAERSAIFYGASQGYRKGDILAIAVAGETEDYLPPCNICRQVMVEFCEPDTLVFLLNGKGNILELRLEELVPYSFSSLEM

SEQ ID NO: 3407 - protein, 760 aa, Streptococcus pneumoniae
  misc_feature (B) LOCATION 1...760
  hypothetical: YES
KMYNYPMRIHYHRKNGEYDTCSFVKSQDQRIDLLTYKEDYFGALFSFEHPSSHVIESLNFVVHTGQTSKEYSIRFNHYPLLTEVWILEGDDRIYYSENPAIASPFYKNQNPFAFDKAINSASFDHHWGYQGELGCRVEDNQAHFSLWSPTATKVQVVVYESAANDAPVWKTFEMKRGNSYSYNHKDNTIGVWSLDVEEDLVGKTYQYQVQFPHHQTLTRDPYTIATSPDGKRSAILSHVEKQVENFEVKHGSEATWRLENPCKAVICEMHIRDLTKSPTSGVDEHLRGTFLGAAQAGTVNQYGQSTAFDYIKKLGYNYVQLQPIADRHKEYDEDGNVTYNWGYDPQNYNAPETSFSTNPDDPAQVIRDLKVMVQAYHDAGIGVIMDVVYNHTFSVVDAPFQTTVPDYYYRMNPDGTFQNGTGVGNETASEHEMFRKYMIDSLLYWVQEYNIDGFRFDLMGIHDVKTMQMIRQSLDEIDSNIILYGEGWDMGTGLAPYDKAKKDNAYQMPNIGFFNDNQRDAVKGGEVYGAIKSGFVSGAATEPILAKAILGSRELGSYTHPNQVLNYVEAHDNYNLHDLLATLHPDQSSEQIMRKVETATAMNLLMQGMAFMEIGQEFGRTKLVATGENGELTHDDRERAMNSYNAPDSVNQVNWNLINERQDSIEFIRQVIRLKTKTGAFSYSSYDEIYHHVFVHSAIEHSGCLIYEVHGKEHLLVVVNAKSEPYQFENAGNLAMLVTNSRSKEDNVLNDISLAVLSVL

SEQ ID NO: 3408 - protein, 152 aa, Streptococcus pneumoniae
  misc_feature (B) LOCATION 1...152
  hypothetical: YES
KWYNIVRRIEEKCKLIAQIDTKTVYSFMESVISIEKYVRAAKEYGYTHLAMMDIDNLYGAFDFLEITKKYGIHPLLGLEMTVFVDDQGVNLRFLALSSVGYQQLMKLSTAKMQGEKTWSVLSQYLEDIAVIVPYFDRVDSLEVGLNKPYTSN

SEQ ID NO: 3409 - protein, 204 aa, Streptococcus pneumoniae
  misc_feature (B) LOCATION 1...204
  hypothetical: YES
VIHKNFSIKYHNASFKEMVTMQYSCGKININIPDGYGDIKDIVFSAHIIVRYNNGHCGGIDPHIIGLCKKQIRRMSLYPILIIVSRDSKVIDDYKNLDIAYVDCTQCSNNFETALHVKNILKLLKIRLIHCHGYSTNYFLYMLKKLDKNGFGKVKTVITCHGWVEYNLKKKFLTYFDFWTYSMGDAFICVSETMKKRLESIIKK

SEQ ID NO: 3410 - protein, 323 aa, Streptococcus pneumoniae
  misc_feature (B) LOCATION 1...323
  hypothetical: YES
ANHKKFHFDFKTVQESQKIILFEREVPTVKVNKIRMRETVISYAFLAPVLFFFVIFVLAPMVMGFITSFFNYSMTRFEFVGLDNYIRMFKDPVFTKSLINTVILVIGSVPVVVLFSLFVASQTYHQNVIARSFYRFVFFLPVVTGSVAVTVVWKWIYDPLSGILNFVLKSSHIISQNISWLGDKNWALMAIMIILLTTSVGQPIILYIAAMGNIDNSLVEAARVDGATEFQVFWKIKWPSLLPTTLYIAIITTINSFQCFALIQLLTSGGPNYSTSTLMYYLYEKAFQLTEYGYANTIGVFLAVMIAIVSFVQFKVLGNDVEY

SEQ ID NO: 3411 - protein, 77 aa, Streptococcus pneumoniae
  misc_feature (B) LOCATION 1...77
  hypothetical: YES
SSHKKMSTDKRSKSMPNYNIPFSPPDITEAEIAEVADTLRSGWITTGPKTKELERRLSLYTQTPKTVCLNSATALWS

SEQ ID NO: 3412 - protein, 241 aa, Streptococcus pneumoniae
  misc_feature (B) LOCATION 1...241
  hypothetical: YES
DWHKMVESYSKNANHNMRRPVVKEEIVDLMRQRQKQVTGFLKELEDFARKENIPIIPHETVAYFRFLMETMQPKNILEIGTAIGFSALLMAEHAPNAKITTIDRNPEMIGFAKENFAQFDSRKQITLLEGDAVDVLSTLTESYDFVFMDSAKSKYIVFLPEILKHLEVGGVVVLDDIFQGGDVAKDIMEVRRGQRTIYRGLQKLFDATLDNPELTATLVPLGDGILMLRKNVADVQLSESE

SEQ ID NO: 3413 - protein, 90 aa, Streptococcus pneumoniae
  misc_feature (B) LOCATION 1...90
  hypothetical: YES
MKNKRYFFDTILIILLLISTIFCVSPVFIKLDILGTPSHAILTFVLAIPLFYILSQCLHTLLLLVSSIFCKLRPIYFYFIFVIIIGADEL

SEQ ID NO: 3414 - protein, 217 aa, Streptococcus pneumoniae
  misc_feature (B) LOCATION 1...217
  hypothetical: YES
KENKMIDIQGLEKKFNDRAIFSGLNLKLEKGKVYALIGKSGSGKTTLLNILGKLEKIDGGRVLYQGKDLKTIPTREYFRDQMGYLFQNFGLLENQSIKENLDLGFVGQKISKVERLERQVGALEKVNLGYLDLEQKIYTLSGGEAQRVALAKTILKNPPLILADEPTAALDPENSEEVMNLLVDLKDENRIIIIATHNPLVWNKADEIIDMRKLAHV

SEQ ID NO: 3415 - protein, 353 aa, Streptococcus pneumoniae
  misc_feature (B) LOCATION 1...353
  hypothetical: YES
GRNKERLLVLVIEGVSEMIKFDNIQIKYGDFVAIDNLNLDIHEGEFFTFLGPSGCGKSTTLRALVGFLDPSSGSIEVNGTDVTHLEPEKRGIGIVFQSYALFPTMTVFDNIAFGLKVKKVAPDVIKAKVSAVAAKIKISDQQLQRNVSELSGGQQQRVALARALVLEPKILCLDEPLSNLDAKLRVDLRKELKRLQKELGITTLYVTHDQEEALTLSDRIAVFNNGYIEQVGTPVEIYHNSQTEFVCDFIGDINVLTDETVHEVLLKNTSVFLEDKKGYIRLEKVRFNRETEQDFILKGTIIDVEFSGVTIHYTIKVSESQILNVTSIDSQAAIRSVGESVELFITPSDVLQF

SEQ ID NO: 3416 - protein, 96 aa, Streptococcus pneumoniae
  misc_feature (B) LOCATION 1...96
  hypothetical: YES
GGNKYVKRSINRCKSCEKIFIIFGWCRIGTLGLKILASKEAKKGYSKALAKAYNLKNKLNASVSVVKQHGNNVLQNAKYLYEQEKKEKQLDSLIGE

SEQ ID NO: 3417 - protein, 143 aa, Streptococcus pneumoniae
  misc_feature (B) LOCATION 1...143
  hypothetical: YES
TMNNLSLVLMDISVQNRQEAYKELANQISLLVSEDTEKIEELLYYRERQGSIEVAKGVLLPHCEGNFQHHVLVITRLKSPIREWSKDIQCVDLIIGLAIAVSQDKSCIKTLMRRLADESFINQLKQLTKEELREIIYGNQRYS

SEQ ID NO: 3418 - protein, 480 aa, Streptococcus pneumoniae
  misc_feature (B) LOCATION 1...480
  hypothetical: YES
KMNKSMIRYLLSKLLLIEAVLLLVPVAIAVYYRESSQVFTALFSTIGILVLLGGSGSLQKPKNQRIYAKEGVLIVALCWILWSFFGGLPFVFSGQIPSVIDAFFEISSGFTTTGASILNDVSVLSRSLLFWRSFTHLIGGMGVLVFALAIMDNAKNSHLEVMKAEVPGPVFGKVVSKLKNTAQILYLLYLALFSLFVIIYYLAGMPLYDSFVIAMGTAGTGGFTVYNDGIAHYGSSLITYLVSIGVLIFGVNFNLYYYLMLRRIKAFFGDEELRAYLVIVLVSTGLISLNTLYLYPGFSKSFEMTFFQVSNIITTTGFGYGDITNWPLFSQFILLFLMTIGGSAGSTAGGLKIIRGLILSKIAKNQILSILSPHRVLTLHVNKTVIDKDTQHKILKYFVIYAMILLSLIFIVSLDSNDFLIVTSAVFSCFNNIGPILGTTSSFSIFSPISKILLSFAMIAGRLEIYPILLLFMKRTWSKR

SEQ ID NO: 3419 - protein, 138 aa, Streptococcus pneumoniae
  misc_feature (B) LOCATION 1...138
  hypothetical: YES
RMNNPKPQEWKSEELSQGRIIDYKAFNFVDGEGVRNSLYVSGCMFHCEGCYNVATWSFNAGIPYTAELEEQIMADLAQPYVQGLTLLGGEPFLNTGILLPLVKRIRKELPDKDIWSWTGYTWEEMMLETPDKLEFLSL

SEQ ID NO: 3420 - protein, 256 aa, Streptococcus pneumoniae
  misc_feature (B) LOCATION 1...256
  hypothetical: YES
FLDKIEVMTRYKATISYDGYAFDGFQRQPHARSVQEEIEKTLTRLNKGQTITVHGAGRTDSGVHALGQVIHFDLPYQMDEEKLRFALDTQSPEDIDVISIELVADDFHCRYAKHSKTYEFIVDRGRPKNPMRRHYATHFPYPLDVERMQIAIKKLEGTHDFTGFTASGTSVEDKVRTITEASLIVDETGQFLTFTFSGNGFLYKQIRNMVGTLLKIGNNRMPVEQIALILEKKDRQLAGPTAAPNGLYLKEIRYEE

SEQ ID NO: 3421 - protein, 60 aa, Streptococcus pneumoniae
  misc_feature (B) LOCATION 1...60
  hypothetical: YES
ALDNHCQPSFHKLIQMIIFYSLWTMLMDNAIWHKSSALKIPTNIGFAFIPPYTPEMNPIE

SEQ ID NO: 3422 - protein, 666 aa, Streptococcus pneumoniae
  misc_feature (B) LOCATION 1...666
  hypothetical: YES
SADKKSMLRNYEIIKKENIMINITFSDGAVREFESGVTTFEIAQSISNSLAKKALAGKFNGKLIDTTRAITEDGSIEIVTPDHEDALPILRHSAAHLFAQAARRLFPDIHLGVGPAIEDGFYYDTDNTAGQISNEDLPRIEEEMQKIVKENFPSIREEVTKDEAREIFKNDPYKLELIEEHSEDEGGLTIYRQGEYVDLCRGPHVPSTGRIQIFHLLHVAGAYWRGNSDNAMMQRIYGTAWFDKKDLKNYLQMREEAKERDHRKLGKELDLFMISQEVGQGLPFWLPNGATIRRELERYIVNKELASGYQHVYTPPLASVELYKTSGHWDHYQEDMFPTMDMGDGEEFVLRPMNCPHHIQVFKHHVHSYRELPIRIAEIGMMHRYEKSGALTGLQRVREMSLNDGHLFVTPEQIQEEFQRALQLIIDVYEDFNLTDYRFRLSLRDPQDTHKYFDNDEMWENAQTMLRAALDEMGVDYFEAEGEAAFYGPKLDIQIKTALGKEETLSTIQLDFLLPERFDLKYIGADGEDHRPVMIHRGVISTMERFTAILIENYKGAFPTWLAPHQVTLIPVSNEKHVDYAWEVAKKLRDRGVRADVDERNEKMQFKIRASQTSKIPYQLIVGDKEMEDETVNVRRYGQKETQTVSVDNFVQAILADIANKSRVEK

SEQ ID NO: 3423 - protein, 239 aa, Streptococcus pneumoniae
  misc_feature (B) LOCATION 1...239
  hypothetical: YES
TADKKSEALYLVQDSVAGLDDYITGKTSDFSTVGVKALDDQTVQYTLVKPELYWNSKTLATILFPVNADFLKSKGDDFGKADPSSILYNGPFLMKALVSKSAIEYKKNPNYWDAKNVFVDDVKLTYYDGSDQESLERNFTAGAYTTARLFPNSSSYEGIKEKYKNNIIYSMQNSTSYFFNFNLDRKSYNYTSKTSDIEKKSTQEAVLNKNFRQAINFAFDRTSYGAQSEGKRRCNKDFA

SEQ ID NO: 3424 - protein, 577 aa, Streptococcus pneumoniae
  misc_feature (B) LOCATION 1...577
  hypothetical: YES
NCDKIVEKSKKELLMNTKELIASKLSSIIDSLDQEAILKLLETPKNSEMGDIAFPAFSLAKVERKAPQMIAAELAEKMNSQAFEKVVATGPYVNFFLDKSAISAQVLQAVTTEKEHYADQNIGKQENVVIDMSSPNIAKPFSIGHLRSTVIGDSLSHIFQKIGYQTVKVNHLGDWGKQFGMLIVAYKKWGDEEAVKAHPIDELLKLYVRINAEAENDPSLDEEAREWFRKLENGDEEALALWQWFRDESLVEFNRLYNELKVEFDSYNGEAFYNDKMDAVVDILSEKGLLLESEGAQVVNLEKYGIEHPALIKKSDGATLYITRDLAAALYRKNEYQFAKSIYVVGQEQSAHFKQLKAVLQEMGYDWSDDITHVPFGLVTKEGKKLSTRKGNVILLEPTIAEAVSRAKVQIEAKNPELENKDQVAHAVGVGAIKFYDLKTDRTNGYDFDLEAMVSFEGETGPYVQYAYARIQSILRKADFKPETSGNYSLNDTESWEIIKLIQDFPRIINRAADNFEPSIIAKFAISLAQSFNKYYAHTRILDESPERDSRLALSYATAVVLKEALRLLGVEAPEKM

SEQ ID NO: 3425 - protein, 93 aa, Streptococcus pneumoniae
  misc_feature (B) LOCATION 1...93
  hypothetical: YES
KRDKGEIKMAEIYLAGGCFWGLEEYFSRISGVLETSVGYANGQVETTNYQLIKETDHAETVQVIYDEKEVSLREILLYYFRVIDPLIYQSTRE

SEQ ID NO: 3426 - protein, 198 aa, Streptococcus pneumoniae
  misc_feature (B) LOCATION 1...198
  hypothetical: YES
MSDNFFGKTLAVRKIDAIPGLLEFDIPVHGDNRGWFKENFQKEKMEPLGFPESFFAAGKLQNNVSFSRKNVLRGLHAEPWDKYISVADDGKVLGSWVDLREGETFGNTYQTVIDASKGIFVPRGVANGFQVLSDTVSYSYLVNDYWALELKPKYAFVNYADPSLGIEWENIAEAEVSEADKNHPLLKDVKPLKKEDLE

SEQ ID NO: 3427 - protein, 62 aa, Streptococcus pneumoniae
  misc_feature (B) LOCATION 1...62
  hypothetical: YES
DKDKTLFSANLLVTNGTKRLATKEDIPIKIGTSDVAITDFEIMYMLAMIVTLKKISAKFANN

SEQ ID NO: 3428 - protein, 191 aa, Streptococcus pneumoniae
  misc_feature (B) LOCATION 1...191
  hypothetical: YES
AEDNLMARLFTLSESKYYLMALDAGTGSIRAVIFDLEGNQIAVGQAEWRHLAVPDVPGSMEFDLNKNWQLACECMRQALHNAGIAPEYIAAVSACSMREGIVLYNNEGAPIWACANVDARAAREVSELKELHNNTFENEVYRATGQTLALSAIPRLLWLAHHRSDIYRQASTITMISDWLAYMLSGELAVD

SEQ ID NO: 3429 - protein, 239 aa, Streptococcus pneumoniae
  misc_feature (B) LOCATION 1...239
  hypothetical: YES
NFCNRKGIEMKIGIIAAMPEELAYLVQHLDNTQEQVVLRNTYHTGTIASHEVVLVESGIGKVMSAMSVAILADHFQVDALINTGSAGAVAEGIAVGDVVIADKLAYHDVDVTAFGYAYGQMAQQPLYFESDKTFVAQIQESLSQLDQNWHLGLIATGDSFVAGNDKIEAIKSHFPEVLAVEMEGAAIAQAAHALNLPVLVIRAMSDNANHEANIFFDEFIIEAGRRSAQVLLTFLKALD

SEQ ID NO: 3430 - protein, 83 aa, Streptococcus pneumoniae
  misc_feature (B) LOCATION 1...83
  hypothetical: YES
QDCKRKGSLMAEVEELRVQPQDILAEQSVLGAIFIDESKLVFVREYIESRDFFKYAHRLIFQAMVDLSDRGDAIDATTVPYYP

SEQ ID NO: 3431 - protein, 467 aa, Streptococcus pneumoniae
  misc_feature (B) LOCATION 1...467
  hypothetical: YES
DYCNGIKYGIIDKIDRIEDVMSFTKFQFKNYIREALKELKFTTPTEVQDKLIPIVLAGRDLVGESKTGSGKTHTFLLPIFQQLDEASDSVQAVITAPSRELATQIYQVARQISAHSDVEVRVVNYVGGTDKARQIEKLASNQPHIVIGTPGRIYDLVKSGDLAIHKAKTFVVDEADMTLDMGFLETVDKIAGSLPKDLQFMVFSATIPQKLQPFLKKYLSNPVMEKIKTKTVISDTIDNWLISTKGHDKNAQIYQLTQLMQPYLAMIFVNTKTRADELHSYLTAQGLKVAKIHGDIAPRERKRIMNQVQNLDFEYIVATDLAARGIDIEGVSHVINDAIPQDLSFFVHRVGRTGRNGLPGTAITLYQPSDDSDIRELEKLGIKFSPKMVKDGEFQDTYDRDRRANREKKQDKLDIEMIGLVKKKKKKVKPGYKKKIQWAVDEKRRKTKRAENRARGRAERKAKRQTF

SEQ ID NO: 3432 - protein, 305 aa, Streptococcus pneumoniae
  misc_feature (B) LOCATION 1...305
  hypothetical: YES
GHCKIMIRKLIVFLLMLPLFVLWLELHVLVNNLLLNLESPLDFVISMSLAFCSLILSKIVLDILYALKDLYKKEALITIFPFIFIGRKKVNVRFSPYFSFHRKSLSPDDLRSRIIWSFILEIAIILVFILKIPFAIIMLTTIFFWTIMDINHLVFNKTEFLFNQNKWEKEDSFESDLTKTLKDKIQKSELSYSDLMSLLLYDAMNQSTFLTDSELFEDILKKIEDSHNTLLCTGFVELLLYEMSISNNNNWSNKVDKIRIHLIRINQLDFFYYTSWLRQNFDFCMNREYHKMKSRKLLLSNKKIV

SEQ ID NO: 3433 - protein, 685 aa, Streptococcus pneumoniae
  misc_feature (B) LOCATION 1...685
  hypothetical: YES
RKCKGKNMTKNLLVELGLEELPAYVVTPSEKQLGEKMAAFLKENRLSFEAIQTFSTPRRLAVRVTGLSDKQSDLTEDFKGPAKKIALDSDGNFTKAAQGFVRGKGLTVEDIEFREIKGEEYVYVTKEEVGQSVEAIVPGVVDVLKSLTFPVSMHWAGNSFEYIRPVHTLTVLLDEQEFDLDFLDIKGSRVSRGHRFLGKETKIQSALSYEEDLRKQFVIADPCEREQMIVDQIKEIEAKHGVRIEIDADLLNEVLNLVEYPTAFMGSFDAKYLEVPEEVLVTSMKEHQRYFVVRDQDGKLLPNFISVRNGNAERLKNVIKGNEKVLVARLEDGEFFWREDQKLVISDLVEKLNNVTFHEKIGSLREHMIRTGQITVLLAEKAGLSVDETVDLARAAAIYKFDLLTGMVGEFDELQGIMGEKYTLLAGETPAVAAAIREHYMPTSAEGELPESKVGAVLAIADKLDTILSFFSVGLIPSGSNDPYALRRATQGVVRILDAFGWHIAMDELIDSLYALKFDSLTYENKAEVMDFIKARVDKMMGSTPKDIKEAVLAGSNFVVADMLEAASALVEVSKEEDFKPSVESLSRAFNLAEKAEGVATVDSALFENDQEKALAEAVETLVLSGPASQQLKQLFALSPVIDAFFENTMVMAEDQAVRQNRLAILSQLTKKAAKFACFNQINTK

SEQ ID NO: 3434 - protein, 357 aa, Streptococcus pneumoniae
  misc_feature (B) LOCATION 1...357
  hypothetical: YES
TYRNGCFTSPSSNLTSSSLLVFMRAFSDFGTPMLIGEGYRTFPVLIYTQFISEVEGNSAFAIMAIIIALAIFLIQKHIANRYSFSMNLIHPIEPKKTTKGKMAAIYATVYGIIFISVLPQIYLIYTSFLKTSGMVFVKGYSPNSYKLAFNRMGSAIFNTIRIPLIALVLVVLFATFISYLAVRKRNLFTNLIDNLSMVPYIVPGTVLGIAFISSFNTGLFGSGFLMITGTAFILIMSLSVRRLPYTIRSSVASLQQIAPSIEEAAESLGSSRLNTFAKITTPMMLSGIISGAILSWVTLISELSTSILYPPLQCQNKNNDCSYLYRGSQRKLRCSRSLVNYPDCSNSRFLALVYENL

SEQ ID NO: 3435 - protein, 121 aa, Streptococcus pneumoniae
  misc_feature (B) LOCATION 1...121
  hypothetical: YES
ATSKSASSVALHRSASRCGTTFKGENIKMGRSLKKGPFVDEHLMKKVEAQANDEKKKVIKTWSRRSTIFPSFIGYTIAVYDGRKHVPVYIQEDMVGHKLGEFAPTRTYKGHAADDKKTRRK

SEQ ID NO: 3436 - protein, 115 aa, Streptococcus pneumoniae
  misc_feature (B) LOCATION 1...115
  hypothetical: YES
DLSKEKLENVSEDIMSIEMTVSEIAEVLGLSRQAINNRVKELPEEDTDKNDKGVTVVTRSGLIKLEEIYKKTIFEDEPVSEDVKQRELMEILVDEKNAAILSLEQCHTRLRICRX

SEQ ID NO: 3437 - protein, 160 aa, Streptococcus pneumoniae
  misc_feature (B) LOCATION 1...160
  hypothetical: YES
KASKFMSRSQLTILTNICLIEDLETQCVVMQYRAPETNRWSGYAFPGGHVENGEAFAESVIREIYEETGLTIQNPQLVGVKNWPLDTGGRYIVFCYKATEFTGTLQSSDEGEVSWVQKDQIPNLNLAYDMLPLMEMMEAPDKSEFFYPRRTEDDWEKKIF

SEQ ID NO: 3438 - protein, 63 aa, Streptococcus pneumoniae
  misc_feature (B) LOCATION 1...63
  hypothetical: YES
LQSNDQTPTRTEQGNLFKLTALAKLSNEDSKLIQYGLQGRVTSVTTKKTYFDYFKDKILTHSD

SEQ ID NO: 3439 - protein, 95 aa, Streptococcus pneumoniae
  misc_feature (B) LOCATION 1...95
  hypothetical: YES
IIGNPKINGSLILNKAGTTDARPIALSCSDLEAKAIYKHSPKVAPEPPAITNILENSPATAKCPPAAFSAMLARAIGLTNAKTMFAPWIPTIQSS

SEQ ID NO: 3440 - protein, 120 aa, Streptococcus pneumoniae
  misc_feature (B) LOCATION 1...120
  hypothetical: YES
KRGNLMEQFLDNIKDLEVTTVVRAQEALDKKETATFFIGRKTCPYCRKFAGTLSGVVAETKAHIYFINSEEPSQLNDLQAFRSRYGIPTVPGFVHITDGQINVRCDSSMSAQEIKDFAGL

SEQ ID NO: 3441 - protein, 441 aa, Streptococcus pneumoniae
  misc_feature (B) LOCATION 1...441
  hypothetical: YES
LVGKKRRFIMSKMDVQKIIAPMMKFVNMRGIIALKDGMLAILPLTVVGSLFLIMGQLPFVGLNKNIASVFGANWTEPFMQVYSGTFAIMGLISCFSIAYSYAKNSGVEALPAGVLSVSAFFILLRSSYIPKQGEAIGDAISKVWFGGQGIIGAIIIGLVVGSIYTFFIKRKIVIKMPEQVPQAIAKQFEAMIPAFVIFLSSMIVYILAKSLTNGGTFIEMIYSAIQVPLQGLTGSLYGAIGIAFFISFLWWFGVHGQSVVNGVVTALLLSNLDANKAMLASANLSLENGAHIVTQQFLDSFLILSGSGITFGLVVAMLFAAKSKQYQALGKVAAFPAIFNVNEPVVFGFPIVMNPVMFVPFILVPVLAAVIVYGAIATGFMQPFSGVTLPWSTPAILSGFLVGGWQGVITQLVILAMSTLVYFPFFKVQDRLAYQNEIKQS

SEQ ID NO: 3442 - protein, 174 aa, Streptococcus pneumoniae
  misc_feature (B) LOCATION 1...174
  hypothetical: YES
FWGKTMNSRVEFRIFTIVDLDKEEEYLHEMHLKGWRYRTSRFGLFYFDQCQPDDVIYRIYDSRFLKKYKHELQDFRDRGWELIGAGSCSILRKSSSDLLPEDQVYMSKGLKWEVMRSRLRSCTTTFLGGLVVCTSLFREDLSMSFFLIFVLYAFLISYLIHGYFRLKRKYRVDE

SEQ ID NO: 3443 - protein, 286 aa, Streptococcus pneumoniae
  misc_feature (B) LOCATION 1...286
  hypothetical: YES
FICLGCDCFGSIFRRKLSAFSGDDRMNKGIYQHFSIEDRPFLDKGMEWIKKVEDSYAPFLTPFINPHQEKLLKILAKTYGLACSSSGEFVSSEYVRVLLYPDYFQPEFSDFEISLQEIVYSNKFEHLTHAKILGTVINQLGIERKLFGDILVDEERAQIMINQQFLLLFQDGLKKIGRIPVSLEERPFTEKIDKLEQYRELDLSVSSFRLDVLLSNVLKLFRNQANQLIEKKLVQVNYHVVDKSDYTVQVGDLISVRKFGRLRLLQDKGQTKKEKKKITVQLLLSK

SEQ ID NO: 3444 - protein, 240 aa, Streptococcus pneumoniae
  misc_feature (B) LOCATION 1...240
  hypothetical: YES
FSILLTNNKVRRIFMYSISFQEDSLLPRERLAKEGVEALSNQELLAILLRTGTRQVSVFEIAQKVLNNLSSLTDLKKMTLQELQSLSGIGRVKAIELQAMIELGHRIHKHETLEMESILSSQKLAKKMQQELGDKKQEHLVALYLNTQNQIIHQQTIFIGSVTRSIAEPREILHYAIKHMATSLILVHNHPSGAVAPSQNDDHVTKLVKEACELMGIVLLDHLIVSHSNYFSYREKTDLI

SEQ ID NO: 3445 - protein, 275 aa, Streptococcus pneumoniae
  misc_feature (B) LOCATION 1...275
  hypothetical: YES
ETILKKNLPFTGNIAYTTREFTYDNPLMQLVRHTIEYIKNQKSIGQGVLDNLSTSRENVSEIVRVTPSYKLADRAKIIRGNQSKPIRHAYFHEYRNLQELCLMILNQEKHGLGYQDQKIYGILFDVAWLWEEYVYTLLPKGFVHPRNKDKTDGISVFSVGKRKVYPDFYDRERKIVLDAKYKKLELTEKGINREDLFQLISYSYILKAEKAGLIFPSMEQSVNSEIGKVAGYGAQLKKWSIRIPQNASSYSAFCKMMENSEENFKAIIDEEVGRK

SEQ ID NO: 3446 - protein, 272 aa, Streptococcus pneumoniae
  misc_feature (B) LOCATION 1...272
  hypothetical: YES
NVFKEGNDMSEETIDYGQVTGMVHSTESFGSVDGPGIRFIVFLQGCHMRCQYCHNPDTWAMESNKSRERTVDDVLTEALRYRGFWGNKGGITVSGGEALLQIDFLIALFTKAKEQGIHCTLDTCALPFRNKPRYLEKFDKLMAVTDLVLLDIKEINEEQHKIVTSQTNKNILACAQYLSDIGKPVWIRHVLVPGLTDRDDDLIELGKFVKTLKNVDKFEILPYHTMGEFKWRELGIPYSLEGVKPPTADRVKNAKKLMDTESYQDYMKRVHG

SEQ ID NO: 3447 - protein, 63 aa, Streptococcus pneumoniae
  misc_feature (B) LOCATION 1...63
  hypothetical: YES
TYFNPIIYRRIFTPFYILEAHKKHYGKFADGSTQEIDVPYDIPDTWEWVRFTTLVKIVKSGSS

SEQ ID NO: 3448 - protein, 67 aa, Streptococcus pneumoniae
  misc_feature (B) LOCATION 1...67
  hypothetical: YES
AHFKITLTFFTKRRKLCVMIMDSAFKFLNSIPSFYLYYERKYNNCQVTKVNFIKKLQAKFVKFTLSR

SEQ ID NO: 3449 - protein, 395 aa, Streptococcus pneumoniae
  misc_feature (B) LOCATION 1...395
  hypothetical: YES
LDFNPCGRRQTGDVVSAEVLTVDATQANVAISGTGVEGVLTLRELTNDRDADINDFVKVGEVLDVLVLRQVVGKDTDTVTYLVSKKRLEARKAWDKLVGREEEVVTVKGTRAVKGGLSVEFEGVRGFIPASMLDTRFVRNAERFVGQEFDTKIKEVNAKENRFILSRREVVEAATAAARAEVFGKLAVGDVVTGKVARITSFGAFIDLGGVDGLVHLTELSHERNVSPKSVVTVGEEIEVKILDLNEEEGRVSLSLKATVPGPWDGVEQKLAKGDVVEGTVKRLTDFGAFVEVLPGIDGLVHVSQISHKRIENPKEALKVGQEVQVKVLEVNADAERVSLSIKALEERPAQEEGQKEEKRAARPRRPRRQEKRDFELPETQTGFSMADLFGDIEL

SEQ ID NO: 3450 - protein, 176 aa, Streptococcus pneumoniae
  misc_feature (B) LOCATION 1...176
  hypothetical: YES
RSFNMEYELLIREAEPKDAAELVAFLNRVSLETDFTSLDGDGILLTSEEMEIFLNKQASSDNQITLLAFLNGKIAGIVNITADQRKRVRHIGDLFIVIGKRYWNNGLGSLLLEEAIEWAQASGILRRLQLTVQTRNQAAVHLYQKHGFVIEGSQERGAYIEEGKFIDVYLMGKLIG

SEQ ID NO: 3451 - protein, 144 aa, Streptococcus pneumoniae
  misc_feature (B) LOCATION 1...144
  hypothetical: YES
SSFKISVSKRVFPCKSHRLRKIPRTFISIPPTTYGILSVIEIVFLRLPDPENSLNSSPVSYMRDCSLSSFMMLVVVAGVSPVSLTISVRDVAGFRYRNSSIVALFCKKKKKKKKKKKKKKRGEKKKKKKKKKKHKQKPPPSFSS

SEQ ID NO: 3452 - protein, 275 aa, Streptococcus pneumoniae
  misc_feature (B) LOCATION 1...275
  hypothetical: YES
IRFKLSRRCSMLASEVIQAYEAFCPQEFSMEGDSRGLQIGTLDKGIQRVMVALDIREETVAEAIEKGVDLIIVKHAPIFRPIKDLLASRPQNQIYIDLIKHDIAVYVSHTNIDIVENGLNDWFCQMLGIEETTYLQETGPERGIGRIGNIQPQTFWELAQQVKQVFDLDSLRMVHYQENDLQKPISRVAICGGSGQSFYKDALAKGADVYITGDIYYHTAQDMLSDGLLALDPGHYIEVLFVEKIAALLTQWKEKKGWELEILPSQASTNPFRHI

SEQ ID NO: 3453 - protein, 319 aa, Streptococcus pneumoniae
  misc_feature (B) LOCATION 1...319
  hypothetical: YES
MDIKIKREEIMKKFSKTLRDNWIFLLMVLPGALWLILFFYIPVFGNVVAFKDYHMTSNGFIDSIINSKWVGLDNFRFLFSSRDAFIITRNTVLYNLGFIFLGLVVSVGIAIILSELRSKRMVKIFQTSMLFPYFLSWVIISFFTDAFLNIDKGVFNHLLESLGLKEVNFYADLGIWPYLLLFLGIWKGFGYSSVMYYATIMGIDPTYYEAATVDGASKWQRIRNVTIPQLTPLVTVLTILAVGNIFRADFGLFYQIPHNAGQLYNVTNVLDVYVFNGLTQTADIGMAAAAGLYQSVVGLILVILSNLLARRVDPNSALF

SEQ ID NO: 3454 - protein, 102 aa, Streptococcus pneumoniae
  misc_feature (B) LOCATION 1...102
  hypothetical: YES
RSINMKQTVKKLALVASIAATLGGSVAVASAAVQYPEGGVWTYGSGNGGAYSNYYHPSKYHSSTVVSRKTGSSDKGYAGAGGTSRAWIRTSWGEKVAFYYNV

SEQ ID NO: 3455 - protein, 92 aa, Streptococcus pneumoniae
  misc_feature (B) LOCATION 1...92
  hypothetical: YES
VAIKIVVPCRLIRSKRFIISHELSGSRFPVGSSAINTLGLFTIARAIAIRCCSPPESSFGKERTLCFNPTRSKTSITRLLILRRFSPITSIA

SEQ ID NO: 3456 - protein, 433 aa, Streptococcus pneumoniae
  misc_feature (B) LOCATION 1...433
  hypothetical: YES
HMINRYSRPEMANIWSEENKYRAWLEVEILSDEAWAELGEIPKEDVALIRKKADFDIDRILEIEQETRHDVVAFTRAVSETLGEERKWVHYGLTSTDVVDTAYGYLYKQANDIIRRDLENFTNIIADKAKEHKFTIMMGRTHGVHAEPTTFGLKLATWYSEMKRNIERFEHAAAGVEAGKISGAVGNFANIPPFVEEYVCDKLGIRAQEISTQVLPRDLHAEYFAVLASIATSIERMATEIRGLQKSEQREVEEFFAKGQKGSSAMPHKRNPIGSENMTGLARVIRGHMITAYENVALWHERDISHSSAERIITPDTTILIDYMLNRFGNIVKNLTVFPENMIRNMNSTFGLIFSQRAMLTLIEKGMTREQAYDLVQPKTAYSWDNQVDFKPLLEADSEVTSRLTQEEIDEIFNPVYYTKRVDDIFERLGLGD

SEQ ID NO: 3457 - protein, 146 aa, Streptococcus pneumoniae
  misc_feature (B) LOCATION 1...146
  hypothetical: YES
IFVKCFILHFYYKFLYHKLLLQKDKDTTFALFDSLFKHSIIFLHSYKNTSDERACFLISLNNKKRKLKPADNLYSHFISFTSVLRTLAYFLALVKCRVTGLNTPLLSLRKPKTADLLFLSSKNMTSNFIVFLDKSLATMQQLIILE

SEQ ID NO: 3458 - protein, 79 aa, Streptococcus pneumoniae
  misc_feature (B) LOCATION 1...79
  hypothetical: YES
GHVKNTLMDHPVNGEIETLLKLSCRRDVQHFLEQVEHSDFRPLSELTDGIHYHLVEAETQQDLHYIEEALDQLGYLVKD

SEQ ID NO: 3459 - protein, 62 aa, Streptococcus pneumoniae
  misc_feature (B) LOCATION 1...62
  hypothetical: YES
QSVKEETDELDKKQAYIVSCHSGLRSYIAEPILKQAGFTAQNLDGAYSLYKMVNPXRVKYGN

SEQ ID NO: 3460 - protein, 293 aa, Streptococcus pneumoniae
  misc_feature (B) LOCATION 1...293
  hypothetical: YES
ISVKLYGPGTCLYLQRGEKTMPSMKEYALQYQKLGFSVIPINPKNKMPLIEFADKPAMTPSEIENFWDGYPNANIALKTTNFFVIDIDKHGKSNGFESLKKWKHLNLIEPTLQAKTASGGKHLFYFKREDEPITQMIGFLPGVDIKAHENNYVLVAPSATDKGQYEWDLEKSKEGGTMVTPSKYLIQSIKKQYGETHGYKYDGKDGLRDLVRRSHTRDRTQTTDLFETIALGFGDEGGRNDKLAKFVGGLLYRAVDDGVVVQLARLANANSPTPLPEKEMMRTIESMIKKDRR

SEQ ID NO: 3461 - protein, 77 aa, Streptococcus pneumoniae
  misc_feature (B) LOCATION 1...77
  hypothetical: YES
TPVKPSAATRSAFLAALAIPFSRSNSIAFSMSPSVSTSAFLASITPAPDFSRNSFTSLAVISAILILLYFLKIGEPG

SEQ ID NO: 3462 - protein, 200 aa, Streptococcus pneumoniae
  misc_feature (B) LOCATION 1...200
  hypothetical: YES
QVVKLTTCYFCDYGSYYGNIPMNWVVIKIKDIFSMNTGLSYKKGDLSINNKGVRIIRGGNIKPLEFSLLDNDYYIDTQFISSEQVYLKHNQLITPVSTSLEHIGKFARIDKDYDGVVAGGFIFQLTPFESSEIISKFLLFNLSSPLFYKQLKAITKLSGQALYNIPKTTLSELLIPLAPFEEQELITQKVEKLFEKVNQL

SEQ ID NO: 3463 - protein, 72 aa, Streptococcus pneumoniae
  misc_feature (B) LOCATION 1...72
  hypothetical: YES
RAVNAVQAGQADAIMAGMTKTKEREKVFTMSDTYYDTKVVIATTKSHKISKYDQLTGKTVCVKNGTGAQRVP

SEQ ID NO: 3464 - protein, 77 aa, Streptococcus pneumoniae
  misc_feature (B) LOCATION 1...77
  hypothetical: YES
YLSKHCSTADFCPRTEPPLTTQTPLHYIGQPHGKIIARLINNIIHTRIQNIFLFILFLLSLFSTYIVPLIKLISKLR

SEQ ID NO: 3465 - protein, 62 aa, Streptococcus pneumoniae
  misc_feature (B) LOCATION 1...62
  hypothetical: YES
DFSNRFILIIPYLKGGEEMRPRRYPYSGKKESTFVKADPELMLNINKIDVGNIQAKNIFGKI

SEQ ID NO: 3466 - protein, 332 aa, Streptococcus pneumoniae
  misc_feature (B) LOCATION 1...332
  hypothetical: YES
SDSKSYKKRILSIPTSKKGNIMKSYQAVYQILSKETDYISGEKIAEKLSLSRTAIWKAIKRLEQEGIEIDSIKNRGYKLMNGDLILPEILEENLPIKVSFKPETKSTQLDAKEAIDLGHEANTLYLASYQTAGRGRFQRSFYSPQGGIYMTLHLKPNLPYDRLPSYTLLVAGAVYKAIKNLTLIDVDIKWVNDIYLNNHKIGGILTEAMTSVETGLVTDIIIGVGINFTIKDFPQELKEKAASLFKATAPITRNELIIEIWRAFFETPAEELLYLYKKQSFILGKEVTFTLEQKDYKGLAKDISENGKLLVQCDNGKEIWLNSGEISLNSWK

SEQ ID NO: 3467 - protein, 111 aa, Streptococcus pneumoniae
  misc_feature (B) LOCATION 1...111
  hypothetical: YES
QLSNLQYWTSLFASPWTIAINLIDILIVAYILYHFTKGIAGTKIMILVRGVLVFIFSSNPCKYDWFDYDLLVIQSNYYLWGYCGGCYLLSRDSDWFGTFGKSDRFLFQCPY

SEQ ID NO: 3468 - protein, 71 aa, Streptococcus pneumoniae
  misc_feature (B) LOCATION 1...71
  hypothetical: YES
TIPNPSNRRYDRVELSHQVIDTCFRLVNEPLVMFDVFITRDKTFMRYQTHDQLKQKAVVRSFRKLSSDWRK

SEQ ID NO: 3469 - protein, 62 aa, Streptococcus pneumoniae
  misc_feature (B) LOCATION 1...62
  hypothetical: YES
NSPKVRVLFLTFERTSFLIQTFSTAIPYAMKSDKFFFITSPLGNLNSIVPSILNITLSKPNP

SEQ ID NO: 3470 - protein, 308 aa, Streptococcus pneumoniae
  misc_feature (B) LOCATION 1...308
  hypothetical: YES
IVTKELLKVWLLMEDQMKSKNGVPFGLLSGIFWGLGLTVSAYIFSIFTDLSPFVVAAAHDFLSIFILLAFLLVKEGKVRLSIFLNIRNVSVIIGALLAGPIGMQANLYAVKYIGSSLASSVSAIYPAISVLLAFFFLKHKISKNTVFGIVLIIGGIIAQTYKVEQVNSFYIGILCALVCAIAWGSESVLSSFAMESELSEIEALLIRQVTSFLSYLVIVLFSHQSFTAVVNGQLLGLMIVFAAFDMISYLAYYIAINRLATSQGYRLERELCSIGRVLFGNCFFRGAPARYADHYDVTCRHCWSLYYY

SEQ ID NO: 3471 - protein, 239 aa, Streptococcus pneumoniae
  misc_feature (B) LOCATION 1...239
  hypothetical: YES
DFTNIWFILPKAIRSIIGNDDLIKIDNTLQYPYSTSAMVLSKYYGVADGMNVEGRGSANFIKDNVLITAAHNYYRHDYGKEADDIYVLPAVSPSQEPFGKIKVKEVRYLKEFRNLNSKDAREYDLALLILEKPIGAKLGTLGLPTSQKNLTGITVTITGYPSYNFKIYQMYTDKKQVLSDDGMFLDYQVDTLEGSSGSTVYDASHRVVGVHTLGDGANQINSAVKLNERNLSFIYLFGS

SEQ ID NO: 3472 - protein, 140 aa, Streptococcus pneumoniae
  misc_feature (B) LOCATION 1...140
  hypothetical: YES
STTNLFSNFVHSTRFKTKEVKTVISKPDKNKLRQKRHRRVRGKLSGTADRPRLNVFRSNTGIYAQVIDDVAGVTLASASTLDKEVSKGTKTEQAVAVGKLVAERANAKGISEVVFDRGGYLYHGRVKALADAARENGLKF

SEQ ID NO: 3473 - protein, 76 aa, Streptococcus pneumoniae
  misc_feature (B) LOCATION 1...76
  hypothetical: YES
KATKPEASFKSPSPLRILDTRLGKLKRSEREAKATKSVGPRAAPTAKQAAKGRLNQRRWAKPPKLRVEIKITGNMR

SEQ ID NO: 3474 - protein, 289 aa, Streptococcus pneumoniae
  misc_feature (B) LOCATION 1...289
  hypothetical: YES
SVTKTRHGVVSMFMRMARRWAMLSLLSYDFIQRAFLAVIAMSLFSPVLGTFLILRRQSLMSDTLSHVSLSGVAFGLVLGISPTVSTIAIVLIAAVFLEYLRTVYKSFMEIGTAILMSTGLAVSLIVMSKGKSSSSMSLDQYLFGSIVTISEEQVISLFVIAAVVLILTFLFLRPMYILTFDEDTAFVDGLPVRTMSILFNMVTGVAIALMIPAAGALLVSTIMVLPASIALRLGKNFKSVMLLASAIGFLGMVAGLYISYYAETPASASITIIFVTVFILISLVRRFIK

SEQ ID NO: 3475 - protein, 93 aa, Streptococcus pneumoniae
  misc_feature (B) LOCATION 1...93
  hypothetical: YES
EATKSAAKNNQNVVQGVMTTLAEIFTPIIPALIVGGLILGFRNVLEGVHWSMLDGKTITESSQFWAGVNHFLWLPGEAIFQFLPVRDYLVCFS

SEQ ID NO: 3476 - protein, 183 aa, Streptococcus pneumoniae
  misc_feature (B) LOCATION 1...183
  hypothetical: YES
KATKQLIRKIHMEQLHFITKLLDIKDPNIQILDIINKDTHKEIIAKLDYDAPSCPECGNQLKKYDFQKPSKIPYLETTGMPTRILLRKRRFKCYHCSKMMVAETSIVKKNHQIPRIINQKIAQKLIEKISMTDIAHQLFISTSTVIRKLNDFHFKHDFSCLPEIMSWDVETVRVVTVSIGRWR

SEQ ID NO: 3477 - protein, 209 aa, Streptococcus pneumoniae
  misc_feature (B) LOCATION 1...209
  hypothetical: YES
TLAKQFYPNFPIRNHQYRFHLSPQAHAKRSGRNFLEKRKLHLLFTPLSKNHQGEIRTMKKQVFHDAATGVLIGLILSILFSLIYAPNTYAPLNPYSLIGQVMDQHQVHGALVLLYCTLIWATIGMLFNFGNRLFSRDWSMLRATLTHFFLMLAGFVPLATLAGWFPFHWIFYLQLIIEFAIVYLIIWAILYKREAKKVDHINQLLEHRK

SEQ ID NO: 3478 - protein, 159 aa, Streptococcus pneumoniae
  misc_feature (B) LOCATION 1...159
  hypothetical: YES
ICAKIGWVDSQMLRLEDGKKEGKSNREIASLLGKAPQTIHTEIKYGTVRKCLGKGRFKEVYSADYAQQSYENNRKHSVKRSSLTKELKEKILHYHNQKFLPEMMVMAKGVNVGISTIYYWIHHGKLGLSKQDLLYPRKGKSVKKQVSPNFKPADQSIES

SEQ ID NO: 3479 - protein, 572 aa, Streptococcus pneumoniae
  misc_feature (B) LOCATION 1...572
  hypothetical: YES
NPAKSIVKSMHPNMERRTRMKRQTVNQTLKRLAVDLASHPFLLFLAFLGTIAQVGLSIYLPILIGQVIDQVLVAGSSPVFWQIFLQMLLVVIGNTLVQWANPLLYNRLIFSYTRDLRERIIHKLHRLPIAFVDRQGSGEMVSRVTTDIEQLAAGLTMIFNQFFIGVLMILVSILAMLQIHLLMTLLVLLLTPLSMVISRFIAKKSYHLFQKQTETRGIQTQLIEESLSQQTIIQSFNAQTEFIQRLREAHDNYSGYSQSAIFYSSTVNPSTRFVNALIYALLAGVGAYRIMMGSALTVGRLVTFLNYVQQYTKPFNDISSVLAELQSALACVERIYGVLDSPEVAETGKEVLTTSDQVKGAISFKHVSFGYHPEKILIKDLSIDIPAGSKVAIVGPTGAGKSTLINLLMRFYPISSGDILLDGQSIYDYTRVSLRQQFGMVLQETWLTQGTIHDNIAFGNPEASREQVIAAAKAANADFFIQQLPQGYDTKLENAGESLSVGQAQLLTIARVFLAIPKILILDEATSSIDTRTEVLVQDAFAKXHEGPHKFHHCSPFVNHSGCGFNSCLSRW

SEQ ID NO: 3480 - protein, 81 aa, Streptococcus pneumoniae
  misc_feature (B) LOCATION 1...81
  hypothetical: YES
VQVLQGPFEYWRITQVRLKGTVLKTVRRVKACVGSNPTSSFYIINAGWSSSVARRAHNPKVVGSNPAPAIRLGSSVGRAMD

SEQ ID NO: 3481 - protein, 62 aa, Streptococcus pneumoniae
  misc_feature (B) LOCATION 1...62
  hypothetical: YES
SEVLDSRGNPTLEVEVYTESGAFGRGMVPSRSFLLVNTKQLNFATVTNLVTVVLVHKKLLTT

SEQ ID NO: 3482 - protein, 61 aa, Streptococcus pneumoniae
  misc_feature (B) LOCATION 1...61
  hypothetical: YES
TQYKKSLLPSSLYSMKIKEQTRKLATGCSKHRFEVVDKTDEVSSKHCFEVADIRQGDADVV

SEQ ID NO: 3483 - protein, 360 aa, Streptococcus pneumoniae
  misc_feature (B) LOCATION 1...360
  hypothetical: YES
LLYKIFFLFCIWSLSFIKHISVIQITINTEIFMPVTIKDVAKAAGVSPSTVTRVIQNKSTISDETKKRVRKAMKELNYHPNLNARSLVSSYTQVIGLVLPDDSDAFYQNPFFPSVLRGISQVASENHYAIQIATGKDEKERLNAISQMVYGKRVDGLIFLYAQEEDPLVKLVAEEQFPFLILGKSLSPFIPLVDNDNVQAGFDATEYFIKKGCKRIAFIGGSKKLFVTKDRLTGYEQALKHYKLTTDNNRIYFADEFLEEKGYKFSKRLFKHDPQIDAIITTDSLLAEGVCNYIAKHQLDVPVLSFDSVNPKLNLAAYVDINSLELGRVSLETILQIINDNKNNKQICYRQLIAHKIIEK

SEQ ID NO: 3484 - protein, 136 aa, Streptococcus pneumoniae
  misc_feature (B) LOCATION 1...136
  hypothetical: YES
QSVLMLTFVQIQVWVPQVHIGNFVEVKGSSIGENTKAGHLTYIGNCEVGSNVNFGAGTITVNYDGKNKYKTVIGVNVFVGSNSTIIAPVELGDNSLVGAGSTITKDVPADAIAIGRGRQINKDEYATRLPHHPKNQ

SEQ ID NO: 3485 - protein, 121 aa, Streptococcus pneumoniae
  misc_feature (B) LOCATION 1...121
  hypothetical: YES
ILNKLLSYSQDLKHHYQLYQLLLFHFQNKEPEKFFGLIEDNLKQAHPLFQTVFKTFLKDKEKIVNALQLHYSNAKLEATNNLIKLIKRNAFGFRNFENFKKRIFIALNIKKERTKFVLSRA

SEQ ID NO: 3486 - protein, 170 aa, Streptococcus pneumoniae
  misc_feature (B) LOCATION 1...170
  hypothetical: YES
LVNKMSKNSIFLLKKRSLKGKESDMRQLAKDINAFLNEVILQAENQHEILIGHCTSEVALTNTQEHILMLLSEESLTNSELARRLNVSQAAVTKAIKSLVKEGMLETSKDSKDARVIFYQLTDLARPIAEEHHHHHEHTLLTYEQVATQFTPNEQKVIQRFLTALVGEIK

SEQ ID NO: 3487 - protein, 379 aa, Streptococcus pneumoniae
  misc_feature (B) LOCATION 1...379
  hypothetical: YES
IMNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGGLKVNPKKKGFFDHIKDAFDGE

SEQ ID NO: 3488 - protein, 71 aa, Streptococcus pneumoniae
  misc_feature (B) LOCATION 1...71
  hypothetical: YES
LSNKFYDSYLVGMLLFFIRQNKRIKGVNFLNPIVLILDVVRNLQSSAPFLVDSEWSAYTGNLLEVPRRQLA

SEQ ID NO: 3489 - protein, 174 aa, Streptococcus pneumoniae
  misc_feature (B) LOCATION 1...174
  hypothetical: YES
YENKGEYMTLEWEEFLDPYIQAVGELKIKLRGIRKQYRKQNKHSPIEFVTGRVKPIESIKEKMARRGITYATLEHDLQDIAGLRVMVQFVDDVKEVVDILHKRQDMRIIQERDYITHRKASGYRSYHVVVEYTVDTINGAKTILAEIQIRTLAMNFWATIEHSLNYKYQGDFPV

SEQ ID NO: 3490 - protein, 664 aa, Streptococcus pneumoniae
  misc_feature (B) LOCATION 1...664
  hypothetical: YES
EVDKMNQTVLDVKNLKTEFITDKKAFPIIKDVNFTLERGKVLGIVGESGCGKSVTVNTVLNLLPKNGRIAEGEITYFDEDKPIELQKLKQYGKEFRKLRGENISMIFQDPMSALNPVYTIGNQITEVLHEHYDISKEEANKRAIEMLEKLGIHNAAERMNDYPHQFSGGQRQRIVIAIAMVCNPDILIADEPTTALDVTIQAQILDLLDDLRKEHGTSIILITHDLGVIAQIADEVAVMYAGEVVEVGTVAQIFDQPKHPYTRSLLRSIPNPENMDKKLHVIQGSVPSISEISEKGCRFANRIPWLEKEHHEEEPQLHDLGDGHFVRCSCYKHFFFEDKEEETLAEKHVGNVVLEVKNIKKYYYPKKQLFKPLGSPLKALDDVSLELRKGTTIGIVGESGSGKSTIAKSLMKLHDITDGEINIDLNGKTQNIYGIKRKEDLDFRKKVQMVFQDPYASLNPTKKIYNSFDEPMIVHNIGNKEERFERMKEALKMVNVPVEYLERYPHEFSGGQRQRLCIARALCMKPEILILDEPVSALDLSVQAQVLNYLVEIQNKEDLTYVFISHDLGVVKYMCDYLYVIHKGRIVEAGSREDIYNNPMHIYTKKLLAAIPEVDYHFKEALATKRKENEVEFKAQYHEFYDEDGRAYDLKQVSPTHFVALKPE

SEQ ID NO: 3491 - protein, 78 aa, Streptococcus pneumoniae
  misc_feature (B) LOCATION 1...78
  hypothetical: YES
NYDKTHSQEGYDILKGEGGCIVCPTKVGYIIMTSNKAGLERKFAAKERKRNKPGVVLCGSMDELRALAQLNPEIEAFY

SEQ ID NO: 3492 - protein, 168 aa, Streptococcus pneumoniae
  misc_feature (B) LOCATION 1...168
  hypothetical: YES
SPCKKVAHRVAFFDYSKGGDGKLSGLRIKQKRFADEYIISGNATEAYKKAGYRVSSDRVAGVEGHKLLKNPKIKSYIDERLKQLDSEKIADQQEVLGYLTSVMRGETQEQTLISIGELGQTITDIDVGAKDRIKAAELLGKRHRLWTDKVEADVSGTVVFANESDISD

SEQ ID NO: 3493 - protein, 87 aa, Streptococcus pneumoniae
  misc_feature (B) LOCATION 1...87
  hypothetical: YES
CVCKARQKGFDVVVEILHHILQEDVQIVLLGTGDPAFEGAFSWFAQIYPDKLSANITFDVKLAQEIYGACDLFLMPSRFEPYGLSYM

SEQ ID NO: 3494 - protein, 79 aa, Streptococcus pneumoniae
  misc_feature (B) LOCATION 1...79
  hypothetical: YES
GLCKRSIGFNEVEENINQGTGQITTFNQLGFKGYSDKPDGWYLPKNMNDVAIILETKSEERDISKQIFIDELMKNIDII

SEQ ID NO: 3495 - protein, 153 aa, Streptococcus pneumoniae
  misc_feature (B) LOCATION 1...153
  hypothetical: YES
GKCNGKPNFRRKKVNTDYIARYGVYAVIPNPEQKQIVLVQEPNGAWFLPCGKIEAGENHQEALKRELIEELGFTAEIGTYYGQADEYFYSRHRDAYYYNPAYLYEATPFKEVQKPLENFNHIAWFPIDEAIKNLKRGSHKWAIESWKKQHKID

SEQ ID NO: 3496 - protein, 72 aa, Streptococcus pneumoniae
  misc_feature (B) LOCATION 1...72
  hypothetical: YES
AYRKGTVFSSAKPHSVLTTMCPCHHELPNGLTRKYSRLKQDVNKSIRKVKLISRNILTVITDYSRFNLLYYF

SEQ ID NO: 3497 - protein, 406 aa, Streptococcus pneumoniae
  misc_feature (B) LOCATION 1...406
  hypothetical: YES
CRRKASTIIYSINKENVMNPNLFRSVEFYQRRYHNYATVFIIPLSLLFTFILIFSLVATKEITVTSQGEIAPTSVIASIQSTSDNPILANHLVANQVVEKGDLLIKYSETMEESQKTALATQLQRLEKQKEGLGILKQSLEKATDLFSSEDEFGYHNTFMNFTKQSHDIELGISKTNTEVSNQANLTNSSSSAIEQEITKVQQQIGEYQELRDAIINNRARLPTGNPHQSILNRYLIASQGQTQGTAEEPFLSQINQSIAGLESSIASLKIQQAGIGSVATYDNSLATKIEVLRTQFLQTASQQQLTVENQLTELKVQLDQATQRLENNTLTAPSKGIVHLNSEFEGKNRIPTGTEIAQIFPVITDTREVLITYYVSSDYLPLLDKGQTVRLKLEKNGNHGTTIIG

SEQ ID NO: 3498 - protein, 63 aa, Streptococcus pneumoniae
  misc_feature (B) LOCATION 1...63
  hypothetical: YES
LRRNIPEGYFGKINQFMEQVYSQGIIYPPKEKVFQALLTTLLEEVKVVILGKTPITDQVKRRA

SEQ ID NO: 3499 - protein, 306 aa, Streptococcus pneumoniae
  misc_feature (B) LOCATION 1...306
  hypothetical: YES
LLSKVQPMLKILTTNEFRNYLDELGDSLLVVNDDEIVKVHVHTEDPGLVMQEGLKYGSLVKVKVDNMRNQHEAQVEKEATQVIKSAEEKEYALIAVVAGKGLADIFCSQGVDYVIEGGQTMNPSTEDFIKAVEQVNARNIIFLPNNKNIFMAAQSAAEVLEQPAVVVEARTLPQGMTSLLAFDPSKSIEENQERMTAALSDVVSGSVTTAVRDTTIDGLEIHENDNLGMVDGKILVSNPDMHQTLTETLKHMLDEDSEIVTFYVGEDGSEELANEIAQEIVEEFEDVEVEIHQGQQPVYPYLFSVE

SEQ ID NO: 3500 - protein, 98 aa, Streptococcus pneumoniae
  misc_feature (B) LOCATION 1...98
  hypothetical: YES
KRSKLMKKETFTEKLIKRTYGISGPLDEYKRREADSIGNQVFIVLFYLMIFGNLIPLLLAYKYPQEVALIYPPLILVIALIAAGYVTYQMKKNRHHSH

SEQ ID NO: 3501 - protein, 71 aa, Streptococcus pneumoniae
  misc_feature (B) LOCATION 1...71
  hypothetical: YES
VFLNFFSSSVPTATYHSPYGIRTRVTAVKRRCLNPLTNGPELLFSTLTIIQSFQTLSTTFSNFFHFFCMTY

SEQ ID NO: 3502 - protein, 69 aa, Streptococcus pneumoniae
  misc_feature (B) LOCATION 1...69
  hypothetical: YES
AFLNFFSSSVPTATYHSPYGIRTRVTAVKRRCLNPLTNGPELLFSTLTIIQSFYVLSTTFSNFFYFFNL

SEQ ID NO: 3503 - protein, 115 aa, Streptococcus pneumoniae
  misc_feature (B) LOCATION 1...115
  hypothetical: YES
MNLNQLDIIVSNVPQVCADLEHILDKKADYADDGFAQFTIGSHCLMLSQNHLVPLENFQSGIIIHIEVEDVDQNYKRLNELGIKVLHGPTVTDWGTESLLVQGPAGLVLDFYRMK

SEQ ID NO: 3504 - protein, 63 aa, Streptococcus pneumoniae
  misc_feature (B) LOCATION 1...63
  hypothetical: YES
IDLNSQIILFSSYFILLYNPVEKTRVHIKKVLASCNTFLRGSFILFLFQLTISPMVLVQKARL

SEQ ID NO: 3505 - protein, 267 aa, Streptococcus pneumoniae
  misc_feature (B) LOCATION 1...267
  hypothetical: YES
QISLKLASSIACLYWLKTGYFKFSFRPSGMEKSVIIIEKEKRMHKILLIEDDQVIRQQVGKMLSEWGFEVVLVEDFMKVLSLFVQSEPHLVLMDIGLPLFNGYHWCQEIRKISKVPIMFLSSRDQAMDIVMAINMGADDFVTKPFDQQVLLAKVQGLLRRSYEFGRDESLLEYAGVILNTKSMDLHYQGQVLNLTKNEFQILRVLFEHAGNIVARDDLMRELWNSDFFIDDNTLSVNVARLRKKLEEQGLVGFIETKKGIGYGLKHA

SEQ ID NO: 3506 - protein, 463 aa, Streptococcus pneumoniae
  misc_feature (B) LOCATION 1...463
  hypothetical: YES
KSLKTMLQWIKNFSIPLIYLSFLLLWLYYAIFSASYLALLGFVFLLVCLFFQFPWKSASKVLVICGIFGFWFVFQNWQQSQASQNLADSVERVRILPDTIKVNGDSLSFRGKSNGRAFQVYYKLQSEEEKEAFQALTDLHEIGLEGKLSEPEGQRNFGGFNYQAYLKTQGIYQTLNIKRIQSLQKVGSWDIGEKLSSLRRKAVVWIKMHFPDPMRNYMTGLLLGHLDTDFEEMNELYSSLGIIHXFALSGMQVGFFMNGFKKLLLRLGLTQEKLKWLTYPFSLIYAGLTGFSASVIRSLLQKLLAQHGVKGLDNFALTVLVLFIVMPNFFLTAGGVLSCAYAFILTMTIKEGKGLKAVASESLVISLGILPIISFYFAEFQPWSILLTFVFSFLFDLTLLPLLSILFVLSFLYPVIQLNFIFEWLEGIIRLVSQVTSRPLVFGQPNEWLLTLLLNILWLWSMI

SEQ ID NO: 3507 - protein, 67 aa, Streptococcus pneumoniae
  misc_feature (B) LOCATION 1...67
  hypothetical: YES
NQLKTEQIYWEIQITFLKYFRNRSVIFQIQFTIKLAFLLQKKKERLPFVPFLLLATCLIIFGKLLLV

SEQ ID NO: 3508 - protein, 192 aa, Streptococcus pneumoniae
  misc_feature (B) LOCATION 1...192
  hypothetical: YES
NKLNKEKIMVKVAVILAQGFEEIEALTVVDVLRRANITCDMVGFEEQVTGSHAIQVRADHVFDGDLSDYDMIVLPGGMPGSAHLRDNQTLIQELQSFEQEGKKLAAICAAPIALNQAEILKNKRYTCYDGVQEQILDGHYVKETVVVDGQLTTSRGPSTALAFAYELVEQLGGDAESLRTGMLYQDVFGKNQ

SEQ ID NO: 3509 - protein, 249 aa, Streptococcus pneumoniae
  misc_feature (B) LOCATION 1...249
  hypothetical: YES
ERLKCEKRRFLMGRKWANIVAKKTAKDGANSKVYAKFGVEIYVAAKKGDPDPESNSALKFVIDRAKQAQVPKHIIDKAIDKAKGNTDETFTEGRYEGFGPNGSMLIVDTLTSNVNRTAANVRAAFGKNGGNMGASGSVSYLFDNKGVIVFGGEDADAVFEQLLEADVDVDDVEAQEGTITVYTAPTDLHKAIVALRESGIEEFQVTELEMIPQSEVELSGEDLETFEKLYSVLEDDEDVQKIYTNVDGF

SEQ ID NO: 3510 - protein, 95 aa, Streptococcus pneumoniae
  misc_feature (B) LOCATION 1...95
  hypothetical: YES
NMLKEIKRRNRMKNKRLIGIIAALAVLVAGSLIYSSMNKSEAQNNKDEKKITKIGVLQFVSHPSLDLIYKGIQDGLAEERYKDDQVKIDFMNSER

SEQ ID NO: 3511 - protein, 95 aa, Streptococcus pneumoniae
  misc_feature (B) LOCATION 1...95
  hypothetical: YES
IMLKIGTACGSGLGSSFMVQMNIESVLSDLNVSDVEVEHYDLGGADPNAADIWIVGRDLADSASHLGDVRILNSIIDMDELRELITKICEEKGLI

SEQ ID NO: 3512 - protein, 66 aa, Streptococcus pneumoniae
  misc_feature (B) LOCATION 1...66
  hypothetical: YES
KMLNLQFAETMELTEAELETVYGGEFGNNAVIPAGAWGGLGTSWSITNFWKKYFNHDSSTVNRRHY

SEQ ID NO: 3513 - protein, 126 aa, Streptococcus pneumoniae
  misc_feature (B) LOCATION 1...126
  hypothetical: YES
MALKYTTWKVTDEKELKLRLTSHQTATVEEKIGMNLLKIFMPEAGEEFTLPPLKVMLLLVHGALQQYEHGYSLEDVYDLYDEYVDNGGDQTTFMTEVLMPLFEVSGFTPRGSKDKKTSKKKMTVDK

SEQ ID NO: 3514 - protein, 114 aa, Streptococcus pneumoniae
  misc_feature (B) LOCATION 1...114
  hypothetical: YES
RKLKKEENKMNKTTEMIVFRSRKTGEFLNSYKDRSSLAFAADFCSLEYCLKLPRKKYEDNKKTYKALAAAFDCEIVAVEAEYKLTYPNGSEVEPIKRDRSSIEDMIKDIIGGVL

SEQ ID NO: 3515 - protein, 650 aa, Streptococcus pneumoniae
  misc_feature (B) LOCATION 1...650
  hypothetical: YES
LHSLVIFVKINANTNESENKMTRYQDDFYDAINGEWQQTAEIPADKSQTGGFVDLDQEIEDLMLATTDKWLAGEEVPEDAILENFVKYHRLVRDFDKREADGITPVLPLLKEFQELETFADFTAKLAEFELAGKPNFLPFGVSPDFMDARINVLWASAPSTILPDTTYYAEEHPQREELLTLWKESSANLLKAYDFSDEEIEDLLEKRLELDRRVAAVVLSNEESSEYAKLYHPYSYEDFKKFAPALPLDDFFKAVIGQLPDKVIVDEERFWQAAEQFYSEEAWSLLKATLILSVVNLSTSYLTEDIRVLSGAYSRTLSGVPEAKDKVKAAYHLAQEPFKQALGLWYAREKFSPEAKADVEKKVATMIDVYKERLLKNDWLTPETCKQAIVKLNVIKPYIGYPEELPARYKDKVVNETASLFENALAFARVEIKHSWSKWNQPVNYKEWGMPAHMVNAYYNPQKNLIVFPAAILQAPFYDLHQSSSANYGGIGAVIAHEISHAFDTNGASFDENGSLKDWWTESDYAAFKEKTQKVIDQFDGQDSYGATINGKLTVSENVADLGGIAAALEAAKREADFSAEEFFYNFGRIWRMKGRPEFMKLLASVDVHAPAKLRVNVQVPNFDDFFTTYDVKEGDGMWRSPEERVIIW

SEQ ID NO: 3516 - protein, 190 aa, Streptococcus pneumoniae
  misc_feature (B) LOCATION 1...190
  hypothetical: YES
PLLKIKEKRMKKEQIPNLLTIGRILFIPIFIFILTIGNSIESHIVAAIIFAVASITDYLDGYLARKWNVVSNFGKFADPMADKLLVMSAFIMLIELGMAPAWIVAVIICRELAVTGLRLLLVETGGTILAAAMPGKIKTFSQMFAIIFLLLHWTLLGQVLLYVALFFTIYSGYDYFKGSAYVFKGTFGSK

SEQ ID NO: 3517 - protein, 77 aa, Streptococcus pneumoniae
  misc_feature (B) LOCATION 1...77
  hypothetical: YES
PKLNFKKRGWLFSQSFEGAKATAIIMSLLETAKRHQLNSEKYLFYLLECLPNEETLVNKEVLEAYLPWTKVVQEKCK

SEQ ID NO: 3518 - protein, 445 aa, Streptococcus pneumoniae
  misc_feature (B) LOCATION 1...445
  hypothetical: YES
NNINKMKEIENNQWIANYRTDQPHFGLERMVELLALRGNPHLKLKVLHIGGTNGKGSTIAFLKKMLEKLGLRVGVFSSPYLIHYTDQISINGESISEVRLEALMADYQSLLEGEAVANLQGTTEFEIITALAYDYFASEQVDVAIMEVGMGGLLDSTNVCQPILTGITTIGLDHVALLGDTLEAIAEQKAGIIKQGMPLVTGRIAPEALAVIDRIAEGKDAPRLAYGTDYQVRHQESVVTGEVFDYTSAVRQGRFQTSLLGLYQIENAGMAIALLDTFCQEDGRELASNDFLGQALEETSWPGRLEIVSRDPLMILDGAHNPHAIKALLVTLQERFADYHKEILFTCIKTKALEDMLDLLGAMPDTELTLTHFADSRATDENVLKEAAKSRNLSYQDWHDFLEQNLTDKKEEKQTVRIVTGSLYFLSQVRAYLMERKNENGYTKD

SEQ ID NO: 3519 - protein, 118 aa, Streptococcus pneumoniae
  misc_feature (B) LOCATION 1...118
  hypothetical: YES
TIIKLSFNVNHWVTCKNTVSHRFYQTFFNRWDKFTRNHTTDDCVFEFESFTFFVWSKFNPYITELTFTTRLTFEESTCLSRSAECFTVRYLRRTYVRFNFELTTHTINKDVKVKFTHT

SEQ ID NO: 3520 - protein, 78 aa, Streptococcus pneumoniae
  misc_feature (B) LOCATION 1...78
  hypothetical: YES
YSIKIKEQTRKLAAVSSKHCFEVVDRTDEVSSKHCFEVVDRTDEVSNHIYSKAKLTWFEEIFKEYKLYFYNLNLVFTE

SEQ ID NO: 3521 - protein, 351 aa, Streptococcus pneumoniae
  misc_feature (B) LOCATION 1...351
  hypothetical: YES
KAINNRKERKAMTVQMEYEKDVKVAALDGKKIAVIGYGSQGHAHAQNLRDSGRDVIIGVRPGKSFDKAKEDGFDTYTVAEATKLADVIMILAPDEIQQELYEAEIAPNLEAGNAVGFAHGFNIHFEFIKVPADVDVFMCAPKGPGHLVRRTYEEGFGVPALYAVYQDATGNAKNIAMDWCKGVGAARVGLLETTYKEETEEDLFGEQAVLCGGLTALIEAGFEVLTEAGYAPELAYFEVLHEMKLIVDLIYEGGFKKMRQSISNTAEYGDYVSGPRVITEQVKENMKAVLADIQNGKFANDFVNDYKAGRPKLTAYREQAANLEIEKVGAELRKAMPFVGKNDDDAFKIYN

SEQ ID NO: 3522 - protein, 76 aa, Streptococcus pneumoniae
  misc_feature (B) LOCATION 1...76
  hypothetical: YES
IKINHCDCLSSANLKSIPTYLLYKPKANLAGYGIHELLENAWMPSMNDHDIWQDVLFLEPENSKLLLIILPSNHAS

SEQ ID NO: 3523 - protein, 77 aa, Streptococcus pneumoniae
  misc_feature (B) LOCATION 1...77
  hypothetical: YES
DKINITGEIIMSVEEKLNQAKGSIKEGVGKAIGDEKMEKEGAAEKVVSKVKEVAEDAKDAVEGAVEGVKNMLSGDDK

SEQ ID NO: 3524 - protein, 257 aa, Streptococcus pneumoniae
  misc_feature (B) LOCATION 1...257
  hypothetical: YES
EKIKEVEGSIPCRPSLLFNGDRKMMNELFGEFLGTLILILLGNGVVAGVVLPKTKSNSSGWIVITMGWGIAVAVAVFVSGKLSPAHLNPAVTIGVALKGGLPWASVLPYILAQFAGAMLGQILVWLQFKPHYEAEENAGNILATFSTGPAIKDTVSNLISEILGTFVLVLTIFALGLYDFQAGIGTFAVGTLIVGIGLSLGGTTGYALNPARDLGPRIMHSILPIPNKGDGDWSYAWIPVVGPVIGAALAVLVFSLF

SEQ ID NO: 3525 - protein, 113 aa, Streptococcus pneumoniae
  misc_feature (B) LOCATION 1...113
  hypothetical: YES
AEINGIIAVLAGILVYGGVQLIGLTANHEMRIFILIILTSLVFMSMVTTLATWNSRIGAFFSLILLLLQLASSAGTYPLALTNDFFRSINPWLPMSYSVSGLRQTISINKSFS

SEQ ID NO: 3526 - protein, 233 aa, Streptococcus pneumoniae
  misc_feature (B) LOCATION 1...233
  hypothetical: YES
KEINMFASKSERKVHYSIRKFSIGVASVAVASLVMGSVVHATEKEVTTQVATSSNRANESQAGHRKAAEQFDEYIKTMIQLDRRKHTQNFALNIKLSRIKTEYLRKLNVLEEKSKAELPSETKKEIDAAFEQFKKDTNRTKKTVAEAEKKVEEAKKKAKAQKEEDHRNYPTNTYKTLELEIAESDVEVKKAELELVKEEAKESRDDEKIKQAEAKVESKKAEATRLDKHQDRS

SEQ ID NO: 3527 - protein, 158 aa, Streptococcus pneumoniae
  misc_feature (B) LOCATION 1...158
  hypothetical: YES
SRINDNRKEKIMKIRGFELVSSFTDENLLPKRETAHAAGYDLKVAVRTVVAPGEIVLVPTGVKAYMQPTEVLYLYDRSSNPRKKGLVLINSVGVIDGDYYGNPGNEGHIFAQMKNITDQEVVLEVGERIVQAVFATFLIADGDAADGVRTGGFGSTGH

SEQ ID NO: 3528 - protein, 447 aa, Streptococcus pneumoniae
  misc_feature (B) LOCATION 1...447
  hypothetical: YES
LMIKNPKLLTKSFLRSFAILGGVGLVIHIAIYLTFPFYYIQLEGEKFNESARVFTEYLKTKTSDEIPSLLQSYSKSLTISAHLKRDIVDKRLPLVHDLDIKDGKLSNYIVMLDMSVSTADGKQVTVQFVHGVDVYKEAKNILLLYLPYTFLVTIAFSFVFSYFYTKRLLNPLFYISEVTSKMQDLDDNIRFDESRKDEVGEVGEIGKQINGMYEHLLKVIHELESRNEQIVKLQNQKVSFVRGASHELKTPLASLRIILENMQHNIGDYKDHPKYIAKSINKIDQMSHLLEEVLESSKFQEWTECRETLTVKPVLVDILSRYQELAHSIGVTIENQLTDATRVVMSLRALDKVLTNLISNAIKYSDKNGRVIISEQDGYLSIKNTCAPLSDQELEHLFDIFYHSQIVTDKDESSGLGLYIVSNILESYQMDYSFLPYEHGMEFKISL

SEQ ID NO: 3529 - protein, 223 aa, Streptococcus pneumoniae
  misc_feature (B) LOCATION 1...223
  hypothetical: YES
MNVKENTELVFREVAEASLSANRESGSVSVIAVTKYVDVPTAEALLPLGVHHIGENRVDKFLEKYEALKDRDVTWHLIGTLQRRKVKDVIQYVDYFHALDSVKLAGEIQKRSDRVIKCFLQVNISKEESKHGFSREELLEILPELAGLDKIEYVGLMTMAPFEASSEQLKEIFKAAQDLQREIQEKQIPNIPMTELSMGMSRDYKEAIQFGSTFVRIGTSFFK

SEQ ID NO: 3530 - protein, 246 aa, Streptococcus pneumoniae
  misc_feature (B) LOCATION 1...246
  hypothetical: YES
NDVKVFLNARKYYRILFHQLMGFSPGIAVFYKESQTTKNLFKFYYFLYFTTLISYYFFFTFVYDKPLLLPLIPFSIIIALVQKLYRIENQQLFLLKSKVLTILESKKNCEFNLQDYHEIWKLQSKSELPCVALSYISLIKPYLSESVREQIDLLEVKRFKKINHPISLYGMLDVIKLNLYLRHYNEKNKYESMLKKILEVRPDFVLIEQNIDDSLNSSQPLSLSLAISEIQLLLEVYMGIKHVSTK

SEQ ID NO: 3531 - protein, 139 aa, Streptococcus pneumoniae
  misc_feature (B) LOCATION 1...139
  hypothetical: YES
QIVKSMIKAFTMLESLLALSLVSILALGLSGSVQSTFAAVEEQIFFMEFEELYRETQKRSVASQQKTSLNLDGQTISNGSQKLPVPKGIQAPSGQSITFDRAGGNSSLAKVEFQTSKGAIRYQLYLGNGKIKRIKETKN

SEQ ID NO: 3532 - protein, 174 aa, Streptococcus pneumoniae
  misc_feature (B) LOCATION 1...174
  hypothetical: YES
SQVKRNEKHMYIEMVDETGQVSKEMLQQTQEILEFAAKKLGKEDKEMAVTFVTNERSHELNLEYRDTDRPTDVISLEYKPELEIAFDEEDLLENPELAEMMSEFDAYIGELFISIDKAHEQAEEYGHSFEREMGFLAVHGFLHINGYDHYTPEEEAEMFGLQEEILTAYGLTRQ

SEQ ID NO: 3533 - protein, 256 aa, Streptococcus pneumoniae
  misc_feature (B) LOCATION 1...256
  hypothetical: YES
SPSKVACMGGFYFIIHDIIEANGGRKMVKVRLYLVRHGKTMFNTIGRAQGWSDTPLTAEGERGIQELGIGLRESDLQFERAYSSDSGRTIQTMGIILEELGLQGKIPYRMDKRIREWCFGSFDGAYDGDLFMGIIPRIFNVDHVHQLSYAELAEGLVEVDTAGWAEGWEKLSGRIKEGFEIIAKEMEDQGGGNALVVSHGMTIGTIVYLINGMHPHGLDNGSVTILEYEDGQFRVEVVGDRSYRELGREKMEEGSI

SEQ ID NO: 3534 - protein, 856 aa, Streptococcus pneumoniae
  misc_feature (B) LOCATION 1...856
  hypothetical: YES
VPSKQKISQGKLNSASGQSPVSEHFKKPKRPRITNLSLFFYREKMIGNYLNLPEQKHLNSHLFMQRNFMEVYFSGTIERIIFENPSNFYRILLLEIDDTDAEDFDDFEIIVTGTMADVIEGEDYTFWGQIVQHSKYGEQLQISRYDRAKPTSKGLVKYFSSSHFKGIGLKTAQKIVDTYGENTIDEILQHPEKLEGIAGLSAKNREAFVSTLRLNYGTEMILAKLANYGIPNKLAFQIQDFYKEETLDVVENYPYQLVEDIKGLGFTIADQLAEELGIESQAPERFRAGLVHSLFQTCMETGDTYVEARDLLEQTLTLLESSRPVELDPSQVAQELSYLIEEDKVQQIDTKIFDNSLFFAEEGIRSHLIRILEKGKQKSQDLETIQKHITTVEQELGIEYDNIQKQAICDAIQNKVFILTGGPGTGKTTVINGIIAVYALLEGLDFRKKNNLPILLAAPTGRAARRMNELTGLPSATIHRHLGMTGDDDTSHLEDYLDADFIIVDEFSMVDTWLANQLFSNISSNSKILIVGDSDQLPSVSPGQVLADLLHIPLIPQTRLEKIYRQSKESTIVTLASQIRQGILPADFTQKKADRSYFEIASGHIPATIEKILGAALRNGIPARDIQVLAPMYRGTAGIDAINQLMQDLLNPPQKDQLSFEAPQCHYRKRDKVIHLVNDAEINVFNGDLGAITDLIPGKYTESKQDEIVIDFDGNEVSYPRNEWYKIRLAYAMSIHKSQGSEFPVVILPITSASRRMLERNLIYTAITRAKSKLILLGELQAFDYATQHIGTARKTYLIERFSDLLENVEEKQQAVSETVTSSASEQSYILTEENWDRIPAMIGITDTDLKEIFGK

SEQ ID NO: 3535 - protein, 249 aa, Streptococcus pneumoniae
  misc_feature (B) LOCATION 1...249
  hypothetical: YES
VFSKFDNLSGLAVGSFGPIDIDKNSKTYGFITTTPKPNWANVDLLGAFRRALNVPMYFTTDVNSSAYGEMVARNNAGGRIENLVYYTIGTGIGAGVIQRGEFIGGVGHPEMGHYYVARHPMDIEKEFKGVCPFHKGCLEGYAAGPSLEARTGVRGENIELNNPVWDVQAYYIAQAAVNATVTFRPDVIVFGGGVMAQQHMLDRVREKFTSLLNGYLPVPDVRDYIVTPAVAGNGSATLGNFVLAKEVSK

SEQ ID NO: 3536 - protein, 66 aa, Streptococcus pneumoniae
  misc_feature (B) LOCATION 1...66
  hypothetical: YES
MISKISWMKIGASPIDGSSKRRSFGVDIRARPMASICCSPPERVAASWFFRSSRRGKREKTFFKLA

SEQ ID NO: 3537 - protein, 217 aa, Streptococcus pneumoniae
  misc_feature (B) LOCATION 1...217
  hypothetical: YES
IPSKERFMNREALRLYLVTNRYQDSVESFLAKVETACRSGVTIVQLREKNLTTNQYYQLAKQVKEITDAYQVPLIIDDRLDVCLAVDAAGLHIGDDELPVSVARQVLGPEKILGVTAKTVKRALEAEKSGADYLGTGAIFPTTTKENAPITLISTLKTICQTVAIPIVAIGGLTSENIDQLMGTGIAGVAVVRDLMQAEDIEAKTQAFLTKLHDILS

SEQ ID NO: 3538 - protein, 140 aa, Streptococcus pneumoniae
  misc_feature (B) LOCATION 1...140
  hypothetical: YES
VPSNPRPVYGLASFKIIFFPSSFSLALYIPPLFENLIALSIIKGKSPCFLSFLSSHLFKKSGGTIPFGILNTGKRSSLTTSSPTINSSIATFFSSSLDGLNTPYLRYIGASSQRLSLKIYGPLYCFKALSNLCKTDSNSF

SEQ ID NO: 3539 - protein, 232 aa, Streptococcus pneumoniae
  misc_feature (B) LOCATION 1...232
  hypothetical: YES
KPSNSQGEQARIQEQGLSLAYQQTSQQVEELETLWKLQEEEIDRLSEGDWQADKEKCQESLATIASDKQNLEAEIEEIKSNKNAIQERYQNLQEEVAQARLLKTKLQGQKRYEVADIERLGKELDNLNIEQEEIQRMLQEKVDNLEKVDTELLSQQAEESKTQKTNLQQGLIRKQFELDDIEGQLDDIASHLDQARQQNEEWMPKQTRAEAKKEKVSERAPSTKSINRPVPD

SEQ ID NO: 3540 - protein, 261 aa, Streptococcus pneumoniae
  misc_feature (B) LOCATION 1...261
  hypothetical: YES
KQSKRLGLAALATVAGLALAACGNSEKKADNATTIKIATVNRSGSEEKRWDKIQELVKKDGITLEFTEFTDYSQPNKATADGEVDLNAFQHYNFLNNWNKENGKDLVAIADTYISPIRLYSGLNGSANKYTKVEDIPANGEIAVPNDATNESRALYLLQSAGLIKLDVSGTALATVANIKENPKNLKITELDASQTARSLSSVDAAVVNNTFVTEAKLDYKKALFKEQADKNSKQWYNIIVAKKDWETSPKADAIKIVIAA

SEQ ID NO: 3541 - protein, 212 aa, Streptococcus pneumoniae
  misc_feature (B) LOCATION 1...212
  hypothetical: YES
TLSNGWCSMSDSRGKSTLAQLIPRLFDPQNGAIKIGGTDIRDVSEGNLRQTVSSFSKRSILFSVTIADNLRQGKGNATLFEMERAANIAQASEFIHRMEKNFESPVEERGTNFSGGQKQRMSIARGIVSNPRILIFDDSTSALDAKSERLVQEALNKDLKGTTTIIIAQKISSVVHADKILVLNQGRLIGQGTHADLVANNAVYREIYETQK

SEQ ID NO: 3542 - protein, 239 aa, Streptococcus pneumoniae
  misc_feature (B) LOCATION 1...239
  hypothetical: YES
ISSKQTLLNVFLDKLAGVSDPEQKRKIIGNESVYVFDDEAGKLKDVKFLAQGTLYTDVVESGTDTAQTIKSHHNVGGLPEDMQFELIEPLNTLYKDEVRALGTELGMPDHIVWRQPFPGPGLAIRVMGEITEEKLETVRESDAILREEIAKAGLDRDIWQYFTVNTGVRSVGVMGDGRTYDYTIAIRAITSIDGMTADFAKIPWEVLQKISVRIVNEVDHVNRIVYDITSKPPATVEWE

SEQ ID NO: 3543 - protein, 88 aa, Streptococcus pneumoniae
  misc_feature (B) LOCATION 1...88
  hypothetical: YES
NASKAISFILFLLILFENLFKPRQRRLTVRMLPTSSVLSATSKLYFEQPTTSFLVCSLIFIDYKMVLILFFKSGTTSASNQGFLAIQI

SEQ ID NO: 3544 - protein, 101 aa, Streptococcus pneumoniae
  misc_feature (B) LOCATION 1...101
  hypothetical: YES
LPPKFAALAQIIPSPVLGGAMLVMFVFVSIQGMQILARVDFANNEHNFLIAAVSIAAGVGLNNSNLFVSMPTAFQMFFSNGIVVASLLAIVLNAVLNHKKK

SEQ ID NO: 3545 - protein, 89 aa, Streptococcus pneumoniae
  misc_feature (B) LOCATION 1...89
  hypothetical: YES
WPPKLDCPFPLQRAQNLSLILSFLTPQNQFNETFFLKTSITYFPYSGLKRISEIRIDLQVYLKSKILIKAKIADPPCFKIIFLSAVKEP

SEQ ID NO: 3546 - protein, 130 aa, Streptococcus pneumoniae
  misc_feature (B) LOCATION 1...130
  hypothetical: YES
KYPKSSEFEDITDDIFKFTTNFTEETLEAGEAWVNDNVPGVKAMTTGFESIDIVLDYVDKGVAIVELVKKLGITMDQVMAFGDNLNDLHMMQVVGHPVAPENARPEILELAKTVIGHHKDQSVIACMEGL

SEQ ID NO: 3547 - protein, 96 aa, Streptococcus pneumoniae
  misc_feature (B) LOCATION 1...96
  hypothetical: YES
PPPKAGGKSKSTNSRLLRHWSTHYLMLDNNAKKLLIKACLSALSTTFSCHTPSFIILYSMKIKEQTRKLAASCSKHCFEVVDKTDEVSHIHTVRRR

SEQ ID NO: 3548 - protein, 155 aa, Streptococcus pneumoniae
  misc_feature (B) LOCATION 1...155
  hypothetical: YES
HFTKEEKIKMKLHELKPAEGSRKVRNRVGRGTSSGNGKTSGRGQKGQKARSGGGVRLGFEGGQTPLFRRLPKRGFTNINAKEYAIVNLDQLNVFEDGAEVTPVVLIEAGIVKAEKSGIKILGNGELTKKLTVKAAKFSKSAEEAITAKGGSVEVI

SEQ ID NO: 3549 - protein, 290 aa, Streptococcus pneumoniae
  misc_feature (B) LOCATION 1...290
  hypothetical: YES
PNTKTRRIKQIMKLAQLFSNFEEELIRQGEEAESLSFVYRSLKNLSFTDFIFALQQEVTTEEEKQFVEDIYQQLAAHKPAQYIIGQADFYGMHLKVDERVLIPRPETEELVELILTENLETNLSVLDIGTGSGAIALALAKNRPDWSVTAADVSQEALELASENASDQNLNIFFKKSDCFAEISEKYDIIVSNPPYISREDESEVGLNVLHSEPHLALFADEDGLAIYCRIAEDAKDYLKDGGKIYLEIGYKQGQSVPELFRKHLPEKKVRTLKDQFGQDRMVVVDDGQD

SEQ ID NO: 3550 - protein, 91 aa, Streptococcus pneumoniae
  misc_feature (B) LOCATION 1...91
  hypothetical: YES
CITKSSTLPSRAQSLCQKNSINMPEKEHKRAHKKRQKQDLLNKGSLFDRLSCSCLPYLRVLVSLYYTFKEILSTENWKFYALKSKNRSIKT

SEQ ID NO: 3551 - protein, 414 aa, Streptococcus pneumoniae
  misc_feature (B) LOCATION 1...414
  hypothetical: YES
NVTNSFTTNRNLNEMEFSMKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKRVHFYYSFRGEENAVYLDLLRDYAQKNPNFELHLIDSTKDGYLNFEQKEVPEHATVYMCGPISMMKALAKQIKKQNPKTELIYEGFKFK

SEQ ID NO: 3552 - protein, 488 aa, Streptococcus pneumoniae
  misc_feature (B) LOCATION 1...488
  hypothetical: YES
ELTNDLYRHILSLPKHSRDRLTTSSLVTRLTSDTYQIQTGINQFLRLFLRAPIIVFGAIFMAYRISAELTFWFLVMVAILTIVIVGLSRLVNPLYSSLRKKTDQLVQETRQQLQGMRVIRAFGQEKRELQIFQTLNQVYARLQEKTGFWSSLLTPLTYLIVNGTLLVIIWQGYISIQGGVLSQGALIALINYLLQILVELVKLAMLINSLNQSYISVKRIEEVFVEAPEDIHSELEQKQATRDKVLQVQELTFTYPDAAQPSLRYISFDMTQGQILGIIGGTGSGKSSLVQLLLGLYPVDKGNIDLYQNGRSPLNLEQWRSWIAYVPQKVELFKGTIRSNLTLGFNQEVSDQELWQALEIAQAKDFVSEKEGLLDALVEAGGRNFSGGQKQRLSIARAVLRQAPFLILDDATSALDTITESKLLKAIRENFPNTSLILISQRTSTLQMADQILLLEKGELLAVGKHDDLMKSSQVYCEINASQHGKED

SEQ ID NO: 3553 - protein, 317 aa, Streptococcus pneumoniae
  misc_feature (B) LOCATION 1...317
  hypothetical: YES
DMTKEFHHVTVLLHETIDMLDVKPDGIYVDATLGGAGHSEYLLSKLSEKGHLYAFDQDQNAIDNAQKRLAPYIEKGVVTFIKDNFRHLQARLREAGVQEIDGICYDLGVSSPQLDQRERGFSYKKDAPLDMRMNQDASLTAYEVVNHYDYHDLVRIFFKYGEDKFSKQIARKIEQAREVKPIETTTELAEIIKLVKPAKELKKKGHPAKQIFQAIRIEVNDELGAADESIQQAMDMLALDGRISVITFHSLEDRLTKQLFKEASTVEVPKGLPFIPDDLKPKMELVSRKPILPSAEELEANNRSHSAKLRVVRKIHK

SEQ ID NO: 3554 - protein, 189 aa, Streptococcus pneumoniae
  misc_feature (B) LOCATION 1...189
  hypothetical: YES
SVTNSLKNDKIGEIFDYQIFKEGIVSYFEQFMQANQAYVALHGQLNLPLKPKTRVAIVTCMDSRLHVAQALGLALGDAHILRNAGGRVTEDMIRSLVISQQQMGTREIVVLHHTDCGAQTFENEPFQEYLKEELGVDVSDQDFLPFQDIEESVREDMQLLIESPLIPDDVIISGAIYNVDTGSMTVVEL

SEQ ID NO: 3555 - protein, 183 aa, Streptococcus pneumoniae
  misc_feature (B) LOCATION 1...183
  hypothetical: YES
KATKQLIRKIHMEQLHFITKLLDIKDPNIQILDIINKDTHKEIIAKLDYDAPSCPECGNQLKKYDFQKPSKIPYLETTGMPTRILLRKRRFKCYHCSKMMVAETSIVKNNHQIPRIINQKIAQKLIEKISMTDIAHQLSISTSTVIRKLNDFHFKHDFSCLPEIMSWDVETVRGVTVSIGRWR

SEQ ID NO: 3556 - protein, 170 aa, Streptococcus pneumoniae
  misc_feature (B) LOCATION 1...170
  hypothetical: YES
KATKQLIRKNHMEQLHFITKLLDIKDPNVQILNIINKDTHKEIIAKLDYDAPSCPECGNQLKKYDFQKPSKIPYLETTGIPTRILLRKRRFKCYHCSKMMVAETSDDVQSYLFSFYYITVLNLALLDSPLLSIYSEKRRKNLRIISGLVIKFFSQYRKVEKVVVFHEYVR

SEQ ID NO: 3557 - protein, 420 aa, Streptococcus pneumoniae
  misc_feature (B) LOCATION 1...420
  hypothetical: YES
KATKQLIRKIHMGQLHFITKLLDIKDTNIQIIDVVNRDSHKEIIAKLDYDAPSCPGCGNQLKKYDFQKPSKIPYLETTGMPTRILLRKRRFKCYQCSKIAVAETSLVKKNHQIPRIINQKIAQKLIEKISMTDIAHQLSISTSTVIRKLNDFHFKHDFSCLPEIMSWDEYAFTKGKMSFIAQDFNNLNIITVLEGRTQAIIRNHFLRYDRVVRCRVKIITMDMFSPYYGLAKQLRFHIVQHLSCAMSRVRVQIMNQFHRKSHEYKAIKRYWKLIQQDSRKLSDKRFYRPTFRIHLTNKEILDKLLSYSQDLKHHYQLYQLLLFHFQNKEPEKFFGLIEDNLKQVHPIFQTVFKTFLKDKEKIVNALQLHYSNVKLEATNNLIKLIKRNAFGFRNFENFKKRIFIALNIKKERTKFVLSRA

SEQ ID NO: 3558 - protein, 183 aa, Streptococcus pneumoniae
  misc_feature (B) LOCATION 1...183
  hypothetical: YES
KATKQLIRKNHMEQLHFITKLLDIKDPNIQILDIINKDTHKEIIAKLDYEAPSCPECGSQMKKYYFQKPSKIPYLETTGMPTRILLRKRRFKCYHCSKIMVAETSIVKKNHQIPRIINQKIAQKLIEKISMTDIAHQLSISTSTVIRKLNDFHFECNFRNLPKIMSWDVETVRGVTVSIGRWR

SEQ ID NO: 3559 - protein, 61 aa, Streptococcus pneumoniae
  misc_feature (B) LOCATION 1...61
  hypothetical: YES
KATKQLIRKNHMEQLHFITKLLDIKEPHIPTFYILPPGGRPRRNPPPGGRKTPLFLVVEFL

SEQ ID NO: 3560 - protein, 183 aa, Streptococcus pneumoniae
  misc_feature (B) LOCATION 1...183
  hypothetical: YES
KATKQLIRKNHMEQLHFITKLLDIKDPNIQILDIINKDTHKEIIAKLDYDAPSCPECGNQLKKYDFQKPSKIPYLETTGMPSRILLRKRRFKCYHCSKMMVAETSIVKKNHQIPRIINQKIAQKLIEKISMTDIAHQLAISTSTVIRKLNDSHFEHDFSRLPEIMSWDVETVRGVTVSIGRWR

SEQ ID NO: 3561 - protein, 183 aa, Streptococcus pneumoniae
  misc_feature (B) LOCATION 1...183
  hypothetical: YES
KATKQLIRKNHMEQLHFITKLLDIKDPNIQILDIINKDTHKEIIAKLDYEAPSCPECGSQMKKYDFQKPSKIPYLETIGMPSRILLRKRRFKCYHCSKMMVAETPLVKKNHQIPRIINQKIAQKLIEKISMTDIAHQLSISTSTVIRKLNDSHFEHDFSRLPEIMSWDVETVRGVTVSIGRWR

SEQ ID NO: 3562 - protein, 429 aa, Streptococcus pneumoniae
  misc_feature (B) LOCATION 1...429
  hypothetical: YES
KATKQLIRKNHMEQLHFITKLLDIKDPNIQILDIINKDTHKEIIAKLDYDAPSCPECGSQMKKYDFQKPSKIPYLETTGMPTRILLRKRRFKCYQCSKIAVAETSLVKKNHQIPRIINQKIAQKLIEKISMTDIAHQLSISTSTVIRKLNDFHFKHDFSCLPEIMSWDEYAFTKGKMSFIAQDFNNLNIITVLEGRTQAIIRNHFLKYDRAVRCRVKIITMDMFSPYYDLARQLFPCAKIVLDRFHIVQHLSRAMSRVRVQIMNQLDRKSHEYKAIKRYWKLIQQDSRKLSDKRFYRPTFRIHLTNKEILNKLLSYSEDLKHHYQLYQLLLFHFQNKEPEKFFGLIEDNLKQVHPLFQTVFKTFLKDKEKIVNALQLHYSNAKLEATNNLIKLIKRNAFGFRNFENFKKRIFIALNIKKERTKFVLSRA

SEQ ID NO: 3563 - protein, 255 aa, Streptococcus pneumoniae
  misc_feature (B) LOCATION 1...255
  hypothetical: YES
PNANGGFEIMTQAILEIKHLKKSYGQNEVLKDISLTVHKGEVISIIGSSGSGKSTFLRSINLLETPTDGQILYHGQNVLEKGYDLTQYREKLGMVFQSFNLFENLNVLENTIVAQTTVLKRERTEAEKIAKENLEKVGMGERYWQAKPKQLSGGQKQRVAIARALSMNPDAILFDEPTSALDPEMVGEVLKIMQDLAQEGLTMIVVTHEMEFARDVSHRVIFMDKGVIAEEGKPEDLFTNPKEDRTKEFLQRYLK

SEQ ID NO: 3564 - protein, 159 aa, Streptococcus pneumoniae
  misc_feature (B) LOCATION 1...159
  hypothetical: YES
GMAKEPWQEDIYDQEESRAGRRHRNHGGADRMANRILTILASIFFVIVVVMVIVLIYLSSGGSNRTAALKDFHDSDASVVQISSSSSSQPEQSSEPESTSSSSEEAANPEGTIKVLAGEGEAAIAARAGISIAQLEALNPGHMATGSWFANPGDVIKIK

SEQ ID NO: 3565 - protein, 161 aa, Streptococcus pneumoniae
  misc_feature (B) LOCATION 1...161
  hypothetical: YES
IMAKKVKIKKTLVEQILSKAAIPHQGIQINALEGELPQGYERDQIFKTLALLGDKTGPIIGIVPITQHLSEKKLAKISGNKKVSMIPQKDLEKTTGYIHGANNPVGIRQKHNYPIFIDKIALDLDRMIVSAGEVGHSIIVAPQDLASFVKADFVDILEDIK

SEQ ID NO: 3566 - protein, 472 aa, Streptococcus pneumoniae
  misc_feature (B) LOCATION 1...472
  hypothetical: YES
KMANKAVNDFILAMNYDKKKLLTHQGESIENRFIKEGNQLPDEFVVIERKKRSLSTNTSDISVTATNDSRLYPGALLVVDETLLENNPTLLAVDRAPMTYSIDLPGLASSDSFLQVEDPSNSSVRGAVNDLLAKWHQDYGQVNNVPARMQYEKITAHSMEQLKVKFGSDFEKTGNSLDIDFNSVHSGEKQIQIVNFKQIYYTVSVDAVKNPGDVFQDTVTVEDLKQRGISAERPLVYISSVAYGRQVYLKLETTSKSDEVEAAFEALIKGVKVAPQTEWKQILDNTEVKAVILGGDPSSGARVVTGKVDMVEDLIQEGSRFTADHPGLPISYTTSFLRDNVVATFQNSTDYVETKVTAYRNGDLLLDHSGAYVAQYYITWNELSYDHQGKEVLTPKAWDRNGQDLTAHFTTSIPLKGNVRNLSVKIRECTGLAWEWWRTVYEKTDLPLVRKRTISIWGTTLYPQVEDKVEND

SEQ ID NO: 3567 - protein, 691 aa, Streptococcus pneumoniae
  misc_feature (B) LOCATION 1...691
  hypothetical: YES
IVPLVRNYRGNFVYKESTMKKLFILLSTFFLSFFLAWIIVLRAPQYLYASYDSVSLLRVKKDTQEPTREVFEQELENFANSEQSLIARRIVEPSKDGTTHFTYATYGQGTLPKEFQEASQESRERSDPLNSYLLLSGSLTKEKLADKLGDLGYKASADRKIPPYFLAFRILLNPLILISLAIFGLSFFALVIITRIKEMRAAGIKLFSGQTLLSIMGHSLSTDIKWLLLSALLSFLGGGVVLFSQGLFYPILLATYGFGISFYLLFLLAISILLMLLYLMSLSYKALVPVIKGRLPLKRLMILTLLCQLVAVFTVGYAVKTGLMSYQRLKELEISKQAWQDRADYYQISFGLGDRGKDTENQSKWYAFAKEAIEEEQALYVKDNLLHFANPQGKNEQGETLDTYSPDANTLYVSPSYLDKEKVVVDAETKQKLAHLQKGEFILLLPEHLRSREAELKKVFEERLSYYGKSGEEASAPLDYEMKAHVSYLSMGEKRFVYNNGENPVSTQYLTDPILVVFTPTSTGDSFISLSSWSINAGKQLFIKGYESGLELLKKAGIYEQVSYLKEGRSVYLTRYNEVQTETATLILGAIVGIASSLLLFYSVNLLYFEQFRRDILIKRISGLRFFETHAQYMVSQFASFVFGASLFILSSRDLVIGLLTLLVFLASAVLTLYRQAQKESRVSMTIMKGK

SEQ ID NO: 3568 - protein, 506 aa, Streptococcus pneumoniae
  misc_feature (B) LOCATION 1...506
  hypothetical: YES
PLQNDPNANQFWFQYARYPKWYTENFVSSSDFGCLYRAPKRMVVRRTRFDKEKAEARAHILEGLLIALDHIDEVIRIIRASETDAEAQAELMSKFKLSERQSQAILDMRLRRLTGLERDKIQSEYDDLLALIADLADILAKPERVSQIIKDELDEVKRKFSDKRRTELMVGQILSLEDEDLIEESDVLITLSNRGYIKRLDQDEFTAQKRGGRGVQGTGVKDDDFVRELVSTSTHDHLLFFTNKGRVYRLKGYEIPEYGRTAKGLPVVNLLKLDEDESIQTVINVESDRSDDAYLFFTTRHGIVKRTSVKEFANIRQNGLKALNLKDEDELINVLLAEGDMDIIIGTKFGYAVRFNQSAVRGMSRIATGVKGVNLREGDTVVGASLITDQDEVLIITEKGYGKRTVATEYPTKGRGGKGMQTAKITEKNGLLAGLMTVQGDEDLMIITDTGVMIRTNLANISQTGRATMGVKVMRLDQDAQIVTFTTVAVAEKEEVGTENETEGEA

SEQ ID NO: 3569 - protein, 72 aa, Streptococcus pneumoniae
  misc_feature (B) LOCATION 1...72
  hypothetical: YES
KLQKTDFHRSEHQKRKDKICPFSSLAFLQPTTVDKEPFLLFKNLISSMHPRRHPLKELRGRHVVSIQFFVLE

SEQ ID NO: 3570 - protein, 78 aa, Streptococcus pneumoniae
  misc_feature (B) LOCATION 1...78
  hypothetical: YES
KLQKTDFYRSEHQKRKDEICPFSSLADFNPLQLTKSQKILFSYSFKIKKGIYRFTDMYITDFYRSCIDRISSLGSFPF

SEQ ID NO: 3571 - protein, 129 aa, Streptococcus pneumoniae
  misc_feature (B) LOCATION 1...129
  hypothetical: YES
QYQNTVARIKTGTQIRGGILMTDTDPIKRAQTLITDLNKAYQACKQATADDVRFQEQLNSILGFLAKAETVDNRFLIELEKFYQTSSLLMGLSALDPDAPTRAAWRAYDRFHFDQVKTKLILNENQRAN

SEQ ID NO: 3572 - protein, 62 aa, Streptococcus pneumoniae
  misc_feature (B) LOCATION 1...62
  hypothetical: YES
VSQKEGIQAKQIVIKITDQGYVTSHGDHYRYYNGKVPFDALFSEELLMKAPNYQPKDQDIVS

SEQ ID NO: 3573 - protein, 71 aa, Streptococcus pneumoniae
  misc_feature (B) LOCATION 1...71
  hypothetical: YES
VIQNHFSPNGFGNIFQLNHKMPPFNNSTRLLFSILEAKPSTNSISRHVKPANSRSGKNAWAKKIKTRRGKL

SEQ ID NO: 3574 - protein, 468 aa, Streptococcus pneumoniae
  misc_feature (B) LOCATION 1...468
  hypothetical: YES
LKQNLERESMLHNAFAYVTRKFFKSIVIFLIILLMASLSLVGLSIKGATAKASQETFKNITNSFSMQINRRVNQGTPRGAGNIKGEDIKKITENKAIESYVKRINAIGDLTGYDLIETPETKKNLTADRAKRFGSSLMITGVNDSSKEDKFVSGSYKLVEGEHLTNDDKDKILLHKDLAAKHGWKVGDKVKLDSNIYDADNEKGAKETVEVTIKGLFDGHNKSAVTYSQELYENTAITDIHTAAKLYGYTEDTAIYGDATFFVTADKNLDDVMKELNGISGINWKSYTLVKSSSNYPALEQSISGMYKMANLLFWGSLSFSVLLLALLLSLWINARRKEVGILLSIGLKQASILGQFITESILIAIPALVSAYFLANYTARAIGNTVLANVTSGVAKQASKAAQASNLGGGAEVDGFSKTLSSLDISIQTSDFIIIFVLALVLVVLVMALASSNLLRKQPKELLLDGE

SEQ ID NO: 3575 - protein, 267 aa, Streptococcus pneumoniae
  misc_feature (B) LOCATION 1...267
  hypothetical: YES
KKQKGEILMAVISMKQLLEAGVHFGHQTRRWNPKMAKYIFTERNGIHVIDLQQTVKYADQAYDFMRDAAANDAVVLFVGTKKQAADAVAEEAVRSGQYFINHRWLGGTLTNWGTIQKRIARLKEIKRMEEDGTFEVLPKKEVALLNKQRARLEKFLGGIEDMPRIPDVMYVVDPHKEQIAVKEAKKLGIPVVAMVDTNTDPDDIDVIIPANDDAIRAVKLITAKLADAIIEGRQGEDAVAVEAEFAASETQADSIEEIVEVVEGDNA

SEQ ID NO: 3576 - protein, 132 aa, Streptococcus pneumoniae
  misc_feature (B) LOCATION 1...132
  hypothetical: YES
LRQKDKRKETKMSWTFDNKKPIYLQIMEKIKLQIVSHTLEPNQQLPTVRELASEAGVNPNTIQRALSDLEREGFVYSKRTTGRFVTKDKELIAQSRKQLSEEELEHFVSSMTHFGYEKEELPGVVSDYIKGV

SEQ ID NO: 3577 - protein, 209 aa, Streptococcus pneumoniae
  misc_feature (B) LOCATION 1...209
  hypothetical: YES
KRQKWQKNLFIRRTTMDNKKLKVKDLVSIGVFGVIYFAFMFGVGMMGLIPILFLIYPTVLAIVAGTVVMLFMAKVQKPWALFIFGMISPLVMFAAGHTYVVVVLSLIVMIIAELIRKIGNYNSFKYNMLSYAIFSTWICSSLMQMLLAKEKYMEWSLMTMGKDYVDVLEKLITYPHMALVALGAFLGGILGAYIGKALLKKHFEKAGIV

SEQ ID NO: 3578 - protein, 218 aa, Streptococcus pneumoniae
  misc_feature (B) LOCATION 1...218
  hypothetical: YES
LMQNLIIGIQKRKNRITLFSSLFLLIIISLSFFILLIGNESYSFSTLIKVLNSETVPGASFSIMEIRLPKLLAGIIAGWSFGLAGFIFQTMLRNPLASPDIIGVTSSSSIAAVFCILVLKTNSLTTGIISITCGLTSSLILFLLAKKDGFSAARLIILGIGFQAVTRAGTSFLLLKVARYELQEVMRWLSGSLSFTKLDDIPLVLXSKYYCYYISFIF

SEQ ID NO: 3579 - protein, 207 aa, Streptococcus pneumoniae
  misc_feature (B) LOCATION 1...207
  hypothetical: YES
EMQKTAFIWDLDGTLLDSYEAILSGIEETFAQFSIPYDKEKVREFIFKYSVQDLLVRVAEDRNLDVEVLNQVRAQSLAEKNAQVVLMPGAREVLAWADESGIQQFIYTHKGNNAFTILKDLGVESYFTEILTSQSGFVRKPSPEAATYLLDKYQLNSDNTYYIGDRTLDVEFAQNSGIQSINFLESTYEGNHRIQALADISRIFETK

SEQ ID NO: 3580 - protein, 88 aa, Streptococcus pneumoniae
  misc_feature (B) LOCATION 1...88
  hypothetical: YES
VYKKEKEYLIMLQKIYEQMTNFYDSIEEEYGPTFGDNFDWEHVHFKFLIYYLVRYGIGCRKDFIVYHYRVAYRLYLEKLVMNRGFISC

SEQ ID NO: 3581 - protein, 232 aa, Streptococcus pneumoniae
  misc_feature (B) LOCATION 1...232
  hypothetical: YES
CYKNKIGADMKTIQIAIDGPASSGKSTVAKIIAKDFGFTYLDTGAMYRAATYMALKNQLGVEEVEALLALLDQHPISFGRSETGDQLVFVGDVDITHPIRENEVTNHVSAIAAIPQVREKLVSLQQEIAQQGGIVMDGRDIGTVVLPQAELKIFLVASVDERAERRYKENIAKGIETDLETLKKEIAARDYKDSHRETSPLKQAEDAVYLDTTGLNIQEVVEKIKAEAEKRM

SEQ ID NO: 3582 - protein, 77 aa, Streptococcus pneumoniae
  misc_feature (B) LOCATION 1...77
  hypothetical: YES
NNKKGELIMKKMKVWSTVLATGVALTTLAACSGGSNSTTASSSEEKADKSQELVIYSNSVSNGRGDWLTAKAKESWF

SEQ ID NO: 3583 - protein, 149 aa, Streptococcus pneumoniae
  misc_feature (B) LOCATION 1...149
  hypothetical: YES
INKKRGEEMLEIQDLLYQLRLSEQASTQLFEKRLGISLTRYQILLFLLEHSPCNQMAVQERLKIDQAALTRHFKILETEGLVERHRNPENQREVLVEAAKYAKEQLVVNPPLQHIRVKEEIESILTEFERTELSRLLNKLVLGIENIEI

SEQ ID NO: 3584 - protein, 111 aa, Streptococcus pneumoniae
  misc_feature (B) LOCATION 1...111
  hypothetical: YES
PRKKEKRMQIPSRFTIATHMLIIIALEGKESKVTSDFLAASVGVNPVIIRKILSQLKKAELISVARGTGGTEIVKDLKDISLLDVYQGGSNVLVRQVNSSVSMTIRIQIAL

SEQ ID NO: 3585 - protein, 190 aa, Streptococcus pneumoniae
  misc_feature (B) LOCATION 1...190
  hypothetical: YES
RGKNMIEASKLKAGMTFETADGKLIRVLEASHHKPGKGNTIMRMKLRDVRTGSTFDTSYRPEEKFEQAIIETVPAQYLYKMDDTAYFMNTETYDQYEIPVVNVENELLYILENSDVKIQFYGTEVIGVTVPTTVELTVAETQPSIKGATVTGSGKPATMETGLVVNVPDFIEAGQKLVINTAEGTYVSRA

SEQ ID NO: 3586 - protein, 301 aa, Streptococcus pneumoniae
  misc_feature (B) LOCATION 1...301
  hypothetical: YES
LVKKLKRLGIEKGISRPDFCGDEQELTVRQLSRIESGASQPSLPKLDYIARRLGVPVYSLMPDFSALPSAYLELKYQILREPIYDKEEEYDKKEACLEEIEDLFYEQLPNEEKVWFEATRATIDVIRSGQPEYGETVLDDYFKTIYDKELFLINELEVINLYFAIVLTKIKQGQNQIEEINRIHSFLVRLTNHVELIAPEYLFALSNTLFSGLACLDNLSSYDSLGAYIFSLNHIMEKTQDFQKKPIILMLEWKLSLIINNDYVSAEQFYQKSKLFADIIENSYLVTMLEKQWQEDLKKYL

SEQ ID NO: 3587 - protein, 106 aa, Streptococcus pneumoniae
  misc_feature (B) LOCATION 1...106
  hypothetical: YES
FSKKNTINFQVSQRGRHKMSDAFTDVAKMKKIKEEIKAHEGQVVEMTLENGRKRQKNRLGKLIEVYPSLFIVEFGDVEGDKQVNVYVESFTYSDILTEKNLIHYLD

SEQ ID NO: 3588 - protein, 108 aa, Streptococcus pneumoniae
  misc_feature (B) LOCATION 1...108
  hypothetical: YES
TNKKTSDTINLAGKGRALYTSIYFLLEETNPSHFHRLTADEIWYFHAGSPLTVHMITADGHYEAVTLGLDISKGQQLHYCVPKGTIWGSTVDKDYALVSCLVAPGFEC

SEQ ID NO: 3589 - protein, 101 aa, Streptococcus pneumoniae
  misc_feature (B) LOCATION 1...101
  hypothetical: YES
IIKKFEFDMMEKVASLGVPMCKPISIELCDDEVHSLHEWIDGRDAIDSILTYSENQQYTYGVEAGKILRKIHTIPATEVCEDWEIFFNLKIDDKISNEMIW

SEQ ID NO: 3590 - protein, 386 aa, Streptococcus pneumoniae
  misc_feature (B) LOCATION 1...386
  hypothetical: YES
NIKNLELYQISMLVSTVFQNPKTYFFNVNTTLELLFYLENIGLAREEMDRRLKDILEIFPIKNLLNRNIFNLSGGEKQILCIAASYIAGTKIIVMDEPSSNLDIKSISVLAKMLKILKEKGISIIVAEHRIYYLMDIVDRVFLIDKGKLKKTYTRSEFLKLDKNELNALSLRDKELSKLKVPYLKEGGEYQIKNLSYKFTDDECLSLKDISFKLGKIYGIIGSNGRGKSTLLRCLIGLEKKSKEEIYFKGEKLSKKERLKNSSLVMQDVNHQLFTDEVFNELRLGVKNFDEEKAKIILKDLCLDEFIERHPMSLSGGRKQRLAIASVMCKNSPFVFFDEPSSGMDYSNMIKISELINKYKTMDKIIFIVSHDIEFLNEVADEIFEL

SEQ ID NO: 3591 - protein, 99 aa, Streptococcus pneumoniae
  misc_feature (B) LOCATION 1...99
  hypothetical: YES
NSKNASYQVYMNYTPKVRQKKSNFWGVFIMKLTYDDKVQIYELRKQGYSLEKLSNKFGINNSNIRYMIKLIDRYGIEFVKKGKNRYYSPDLKQEMINKV

SEQ ID NO: 3592 - protein, 226 aa, Streptococcus pneumoniae
  misc_feature (B) LOCATION 1...226
  hypothetical: YES
KSKKGEVVVILGASGCGKSTLLRCLNGLESIQGGDILLDGQSIVENKKDFHLVRQKIGMVFQSYELFPHLDVLQNLILGPIKAQGRDKKEVTEEALQLLERVGLLDKQHSFARQLSGGQKQRVAIVRALLMHPEIILFDEVTASLDPEMVREVLELINDLTQEGRTMILVTHEMQFAQAITDRIIFLDQGKIAEEGTAQAFFTNPQTKRAQEFLNVFDFSQFGSYL

SEQ ID NO: 3593 - protein, 156 aa, Streptococcus pneumoniae
  misc_feature (B) LOCATION 1...156
  hypothetical: YES
KAKNNLLWQYGLGMTILFVVISASFLYMVSLSMKPYQTAKSEGEKLAQQYAGLEQADQVDLYNGLESYYSVLGRNKQQEALAVLIGKDDHKIYVYQLNQGVSQEKAETVSKEKGAGEIDKIIFGRYQDKPIWEVKSGSDFYLVDFETGALVNKEGL

SEQ ID NO: 3594 - protein, 69 aa, Streptococcus pneumoniae
  misc_feature (B) LOCATION 1...69
  hypothetical: YES
TRKKEESSMTNFDILDNQFLSLSENELSDIDGGLAPLVIFGVAVSWKAIAGGTALIGSGLAAGYFLGGD

SEQ ID NO: 3595 - protein, 83 aa, Streptococcus pneumoniae
  misc_feature (B) LOCATION 1...83
  hypothetical: YES
RRKNMAQQRRGGFKRRKKVDYIAANKIEYVDYKDTELLSRFVSERGKILPRRVTGTSAKNQRKVTTAIKRARVMALMPFVNED

SEQ ID NO: 3596 - protein, 182 aa, Streptococcus pneumoniae
  misc_feature (B) LOCATION 1...182
  hypothetical: YES
DGKKEITGDKMNYFNVGKIVNTQGLQGEMRVLSVTDFAEERFKKGAELALFDEKDQFVQTVTIASHRKQKNFDIIKFKDMYHINTIEKYKGYSLKVAEEDLNDLDDGEFYYHEIIGLEVYEGDSLVGTIKEILQPGANDVWVVKRKGKRDLLLPYIPPVVLNVDIPNKRVDVEILEGLDDED

SEQ ID NO: 3597 - protein, 345 aa, Streptococcus pneumoniae
  misc_feature (B) LOCATION 1...345
  hypothetical: YES
IMKKSDVLDLIKYHYEGRETEFRNQSIAIARNFNKHGDTQIAQYIMGLMSQSDRFMPQIENPSEYLTPAKLDIGPLPLPLSIMNDLKGIINAVNHHIGINKFLFVGSTGTGKTESVKQVARLIGKELLVVDFSHLVDSKLGQTVKNLATLFNEINNLPFKQNYIILFDEIDSIVLDRVNQNDLREMGRVTSAFLKELDRLSPEIVLIATTNLFENLDKAVTRRFDAIIDFDRYTDEDKVEVATIILNELLKQFKNVARDLKLFKKIINSANVIPNPGDLRNSIRTSLAFSDPSDPHDYQKRLLRSLHNGRNLSISKLSKLGFTVREIEILTGVSKSSVSRELSED

SEQ ID NO: 3598 - protein, 348 aa, Streptococcus pneumoniae
  misc_feature (B) LOCATION 1...348
  hypothetical: YES
KMKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDSVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSTGAQVREGAEVLDSVIMSGAIIGQGAKIKRAIIE

SEQ ID NO: 3599 - protein, 239 aa, Streptococcus pneumoniae
  misc_feature (B) LOCATION 1...239
  hypothetical: YES
RMKKYFIGGLGSNAYHSKDFLQELDSQVYFLNPYEKHLRDETELKSWFKNEIVEEEFICLIGHSLGGDLARYLASEFEEVKKLILLDGGYLDLDKILPLDTELEETKNYIKSQIVLDLDVLTSKEKSEAKHWSENMEKAVRQSYHWNVEYNRYELAINYENIEAILRLRRKIQAFKREVGDTLFISPRYPNEATWREEALKELPDYFDTIFLENFGHELYTQAPKEIASLMNEWLAYFL

SEQ ID NO: 3600 - protein, 332 aa, Streptococcus pneumoniae
  misc_feature (B) LOCATION 1...332
  hypothetical: YES
RMKKQAYVIIALTSFLFVFFFSHSLLEILDFDWSIFLHDVEKTEKFVFLLLVFSMSITCLLALFWRGIEELSLRKMQANLKRLLAGQEVVQVADPDLDASFKSLSGKLNLLTEALQKAENHSLAQEEEIIEKERKRIARDLHDTVSQELFAAHMILSGISQQALKLDREKMQIQLQSVTAILETAQKDLRVLLLHLRPVELEQKSLIEGIQILLKELEDKSDLRVSLKQNMTKLPKKIEEHIFRILQELISNTLRHAQASCLDVYLYQTDVELQLKVVDNGIGFRLGSLDDLSYGLRNIKERVEDMAGTVQLLTAPKQGLAVDIRIPLLDKE

SEQ ID NO: 3601 - protein, 69 aa, Streptococcus pneumoniae
  misc_feature (B) LOCATION 1...69
  hypothetical: YES
KQKKEWGGDVLHSLLFPFCYSSKISSNHVSVALPYVWLLTSSVSSTTSKQCFEQPAASFLVFSLIFIEY

SEQ ID NO: 3602 - protein, 1120 aa, Streptococcus pneumoniae
  misc_feature (B) LOCATION 1...1120
  hypothetical: YES
SEKKMGNFSFLLKNDEYESFSKPCIEAENMIATSTVATAFMARRALEQAVHWIYSHDSYLEAPYRATLSSLVWDDDFRDIVDSELHKQIVLLIRWGNHAAHGGEIKEREAILALHHLYQFVNFIDYCYSNEFVERYFDEKCLPLSANIKYRETPQSMIKLQDSLPELPDFHEQMAAQSVEVQETYTEKRETAAQRQDVPFHIDQLSEAETRKLFIDIDLRLAGWIFEENCRVEIAVDGLKHGSGIGYCDYVLYGKNGKILAIVEAKKASVNPEVGEVQVKEYAEALEKHIGYQPICFITNGLKHYILDGPNRRQIAGFYSQEELQLVMDRRHLQKPLEDISSKIRDDISGRHYQKHAIASVCEAFSNHRRQALLVMATGAGKTRTAVSLVDILSRHNWVKNVLFLADRTSLVKQAYDSFRKLLPDLSVCNFLEDKEGAQSSRMVFSTYPTMIGAISGQEEVNQRPFTVGHFDLIIIDESHRSIYQKYKSIFDYFDARIVGLTATPRQDLDKNTYGFFNLENGVPTYAYDLEEAVKDGYLVAYHSIETKLKLPTDGLHYDDLSEEEKEHFDSKFEDDSCEKDIDGSVFNSFVFNKSTVEIVLNELMTRGIQTASGDEIGKTIIFAKNHDHAEYIRGIFNNRYPEKGSDYAQVIDYSIKHYQTLIDDFKIKEKYPQIAISVDMLDTGIDVPEVVNLVFFKKVRSKTKFWQMIGRGTRLCKDLFGPEQDKENFLVFDYGDNFDYFRADPRDGEGRHIVSLTQRLFNIKVDLIRELQGLQYQEDQFARAYRQQLVSELQGRIESLNELDFRVRMVLDTVYSYRKLESWQNLTAVTSETIQKNLSPLLFDEDKEDEMARRFDLWLLHIQLGQLTAKSSTVHISQVMKTARALSAIGNIPQVFEQAEIIRKVQEPEFWKEVNLSDLEKIRLAIRDLLQFLDKTDRKPYYVNFEDRILSTVHETTAFLQVNDLRSYNEKVEHYLKTHLDEESISKLYHNKKLTSDDMLALEKLLWEKLGSKADYQSHYENKAIPRLVREIIGLDRESANRIFSKFLSDENLNARQISFVKLIVDYIVENGFLETKVLTQEPFKSYGSVQLLFQHQLPVLRNIVQIIELINNRAGEAA

SEQ ID NO: 3603 - protein, 390 aa, Streptococcus pneumoniae
  misc_feature (B) LOCATION 1...390
  hypothetical: YES
GEKKMKKKFALSFVALASVALLAACGEVKSGAVNTAGNSVEEKTIKIGFNFEETGSLTAYGTAEQKGAQLAVDEINAAGGIDGKQIEVIDKDNKSETAEAASVTTNLVTQSKVSAVVGPATSGATAAAVANATKAGVPLISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKP

SEQ ID NO: 3604 - protein, 137 aa, Streptococcus pneumoniae
  misc_feature (B) LOCATION 1...137
  hypothetical: YES
EEKNKMVMTDPIADFLTRIRNANQAKHEVLEVPASNIKKGIAEILKREGFVKNVEIIEDDKQGVIRVFLKYGPNGEKVITNLKRVSKPGLRVYKKREDLPKVLNGLGIAILSTSEGLLTDKEARQKNVGGEVIAYVW

SEQ ID NO: 3605 - protein, 297 aa, Streptococcus pneumoniae
  misc_feature (B) LOCATION 1...297
  hypothetical: YES
ERKKMSNISTDLQDVEKIIVLDYGSQYNQLISRRIREIGVFSELKSHKISAAEVREVNPVGIILSGGPNSVYEDGSFDIDPEIFELGIPILGICYGMQLLTHKLGGKVVPAGDAGNREYGQSTLTHTPSALFESTPDEQTVLMSHGDAVTEIPADFVRTGTSADCPYAAIENPDKHIYGIQFHPEVRHSVYGNDILRNFALNICKAKGDWSMDNFIDMQIKKIRETVGDKRVLLGLSGGVDSSVVGVLLQKAIGDQLICIFVNHGLLRKGEADQVMDMLGGNLGLNIVKADAAKRFP

SEQ ID NO: 3606 - protein, 170 aa, Streptococcus pneumoniae
  misc_feature (B) LOCATION 1...170
  hypothetical: YES
EFEKMIDQLSKYYSCRILTEKDIPSILSLYESNPLYFQHCPPEPNFATVKEDMLCLPEGKAKADKFFVGFWNGSDLVAVMDFVYAYPDEETVFIGLFMVDQAYQRKGIGSHIVTEALAYFAKNFRKARLAYVKGNPQSQHFWEKQGFKSIGCEVKQELYTVVIVEQSLDD

SEQ ID NO: 3607 - protein, 838 aa, Streptococcus pneumoniae
  misc_feature (B) LOCATION 1...838
  hypothetical: YES
KLENFYKNRYYIFERNKNIFERKVLTMVNTEVARTTIKTEYFGSLTERMNKYREDVLNKKPYIDAERAVLATRAYERYKEQPNVLKRAYMLKEILENMTIYIEEESMIAGNQASSNKDAPIFPEYTLEFVLNELDLFEKRDGDVFYITEETKEQLRSIAPFWENNNLRARAGALLPEEVSVYMETGFFGMEGKMNSGDAHLAVNYQKLLQFGLRGFEERARKAKVALDLTDPASIDKYHFYDSIFIVIDAIKVYAKRFVALAKSLAENANPKRKKELLEIADICSRVPYEPATTFAEAIQSVWFIQCILQIESNGHSLSYGRFDQYMYPYMKADLESGKETEDSIVERLTNLWIKTITINKVRSQSHTFSSAGSPLYQNVTIGGQTRDKKDAVNPLSYLVLKSVAQTHLPQPNLTVRYHAGLDARFMNECIEVMKLGFGMPAFNNDEIIIPSFIAKGVLEDDAYDYSAIGCVETAVPGKWGYRCTGMSYMNFPKVLLITMNDGIDPASGKRFAPSFGHFKDMKNFSELENAWDKTLRYLTRMSVIVENSIDLSLEREVPDILCSALTDDCIGRGKHLKEGGAVYDYISGLQVGIANLSDSLAAIKKLVFEEERISPSQLWHALETDYAGEEGKVIQEMLIHDAPKYGNDDDYADKLVTAAYDIYVDEIAKYPNTRYGRGPIGGIRYSGTSSISANVGQGRGTLATPDGRNAGTPLAEGCSPSHNMDQHGPTSVLKSVSKLPTDEIVGGVLLNQKVNPQTLAKEEDKLKLIALLRTFFNRLHGYHIQYNVVSRETLIDAQKHPEKHRDLIVRVAGYSAFFNVLSKATQDDIIGRTEHTL

SEQ ID NO: 3608 - protein, 192 aa, Streptococcus pneumoniae
  misc_feature (B) LOCATION 1...192
  hypothetical: YES
FPEKEGSRIEGLYMKSELRKQVLHEMKALSQEQKQAIDQALTERILQHPFYQEAKVIATYLSFSHEFQTRELIEQALKDGKKVLIPKTYPKGRMDFVVYDPQQLVKTAFALLEPQGDLEVVDVSQIDLIHVPGLAFTTDGYRIGYGGGYYDRYLEHFSGHTLSTVHPCQIQDFIPENHDIPVQEVLIDEGNL

SEQ ID NO: 3609 - protein, 101 aa, Streptococcus pneumoniae
  misc_feature (B) LOCATION 1...101
  hypothetical: YES
QYENCCFLVYPMIGTFAAALVAVLASFIVPIEITLNSANTEIAPPDGIGQVLSNLLLKLVDSPVNALLTANYIGILSWAVIFDIAMREARKNSKELAKNYR

SEQ ID NO: 3610 - protein, 763 aa, Streptococcus pneumoniae
  misc_feature (B) LOCATION 1...763
  hypothetical: YES
KNEKIGPFGAVFFSSRNACEIWYNRRMANKNTSTTRRRPSKAELERKEAIQRMLISLGIAILLIFAAFKLGAAGITLYNLIRLLVGSLAYLAIFGLLIYLFFFKWIRKQEGLLSGFFTIFAGLLLIFEAYLVWKYGLDKSVLKGTMAQVVTDLTGFRTTSFAGGGLIGVALYIPTAFLFSNIGTYFIGSILILVGSLLVSPWSVYDIAEFFSRGFAKWWEGHERRKEERFVKQEEKARQKAEKEARLEQEETEKALLDLPPADMETGEILTEEAVQNLPPIPEEKWVEPEIILPQAELKFPEQEDDSDDQDVQVDFSAKEALEYKLPSLQLFAPDKPKDQSKEKKIVRENIKILEATFASFGIKVTVERAEIGPSVTKYEVKPAVGVRVNRISNLSDDLALALAAKDVRIEAPIPGKSLIGIEVPNSDIATVSFRELWEQSQTKAENFLEIPLGKAVNGTARAFDLSKMPHLLVAGSTGSGKSVAVNGIIASILMKARPDQVKFMMVDPKMVELSVYNDIPHLLIPVVTNPRKASKALQKVVDEMENRYELFAKVGVRNIAGFNAKVEEFNSQSEYKQIPLPFIVVIVDELADLMMVASKEVEDAIIRLGQKARAAGIHMILATQRPSVDVISGLIKANVPSRVAFAVSSGTDSRTILDENGAEKLLGRGDMLFKPINENHPVRLQGSFISDDDVERIVNFIKTQADADYDESFDPGEVSENEGEFSDGDAGGDPLFEEAKSLVIEIQKAVGIHDSASFVSWI

SEQ ID NO: 3611 - protein, 201 aa, Streptococcus pneumoniae
  misc_feature (B) LOCATION 1...201
  hypothetical: YES
TSENQALIGWKSMESIFVKLAQYPSIETERLLLRPVTLDDAEAMFDYASDKGNTRYTFPTNQSLEETKNNIAQFYLANPLGRWGIELKSNGQFIGTIDLHKIDSVLKKAAIGYIINKKYWNQGLTTEANRAVIELAFEKIGMNKLTALHDKDNPASGKVMEKSGMRFSHAEPYACMDQHEKGRIVTRVHYVLTKEDYFANK

SEQ ID NO: 3612 - protein, 117 aa, Streptococcus pneumoniae
  misc_feature (B) LOCATION 1...117
  hypothetical: YES
MNEKELLELVVKAADEKRAEDILALDVQDLTSVTDYFVITSSMNSRQLDAIAANIREKVAQAGFKGSHVEGDAAGGWVLLDLGAVVVHIFSEEMRAHYNLEKLWHEANSVDISEALA

SEQ ID NO: 3613 - protein, 263 aa, Streptococcus pneumoniae
  misc_feature (B) LOCATION 1...263
  hypothetical: YES
MDEKKRMQIIAENITHFRKQRGITQKDLAKEVGITASTMTDYMKLRSAPSFGVIQKLADYFGVKKSDIDTTFKEESTNSLPDAPDSLTQQIMDKVVQLTPPNQKIVLRTSEELLESQNEEETKINEVSEVISLYQVEVVSETAAASGFNYGFGYDDTDRETIEVDERPPRHDIATKVSGDSMQPDYQDGDILYLVDKGLTTYNGDLAIIAYGDRSYFKKIYTENGRLRLVSLNDKYEDIILDFPPAEDTHIKIYAVVGVYRGE

SEQ ID NO: 3614 - protein, 112 aa, Streptococcus pneumoniae
  misc_feature (B) LOCATION 1...112
  hypothetical: YES
NLENRYKQMMLKPSIDTLLDKVPSKYSLVILEAKRAHELEAGAPATQGFKSEKSTLRALEEIESGNVTIHPDPEGKREAVRRRIEEEKRRKEEEEKKIKEQIAKEKEDGEKI

SEQ ID NO: 3615 - protein, 82 aa, Streptococcus pneumoniae
  misc_feature (B) LOCATION 1...82
  hypothetical: YES
SLEKGNNMIFKAFKTKKQRKRQVELLLTVFFDSFLIDLFLHLFGIVPFKLDKILIVSLIIFPIISTSIYAYEKLFEKVFDKD

SEQ ID NO: 3616 - protein, 470 aa, Streptococcus pneumoniae
  misc_feature (B) LOCATION 1...470
  hypothetical: YES
KEEKMTAIDFTAEVEKRKEDLLADLFSLLEINSERDDSKADAQHPFGPGPVKALEKFLEIADRDGYPTKNVDNYAGHFEFGDGEEVLGIFAHMDVVPAGSGWDTDPYTPTIKDGRLYARGASDDKGPTTACYYGLKIIKELGLPTSKKVRFIVGTDEESGWADMDYYFEHVGLAKPDFGFSPDAEFPIINGEKGNITEYLHFAGENTGVARLHSFTGGLRENMVPESATAVVSGDLADLQAKLDAFVAEHKLRGELQEEAGKYKVTIIGKSAHGAMPASGVNGATYLALFLSQFGFAGPAKDYLDIAGKILLNDHEGENLKIAHVDEKMGALSMNAGVFHFDETSADNTIALNIRYPKGTSPEQIKSILENLPVVSVSLSEHGHTPHYVPMEDPLVQTLLNIYEKQTGFKGHEQVIGGGTFGRLLERGVAYGAMFPDSIDTMHQANEFIALDDLFRAAAIYAEAIYELIK

SEQ ID NO: 3617 - protein, 135 aa, Streptococcus pneumoniae
  misc_feature (B) LOCATION 1...135
  hypothetical: YES
EEENMYNKVIMIGRLTSTPELHKTNNDKSVARATIAVNRRYKDQNGEREADFVNMVLWGRLAETLATYATKGSLISVDGELRTRRFEKNGQMNYVTEVLVTGFQLLESRAQRAMRENNAGQDLADLVLEEEELPF

SEQ ID NO: 3618 - protein, 112 aa, Streptococcus pneumoniae
  misc_feature (B) LOCATION 1...112
  hypothetical: YES
LRENRRTNRMELKDFTEKEQEMIKKRLTMSNISDKETTEKILALVPQDLIKRIPFFVRKHATTRTIKRISIEHPELYAVAQTSGEIPEKECEELRQIITTIFEQKMNKHSIK

SEQ ID NO: 3619 - protein, 418 aa, Streptococcus pneumoniae
  misc_feature (B) LOCATION 1...418
  hypothetical: YES
KRENRMVLPNFKENLEKYAKLLVANGINVQPGHTLALSIDVEQRELAHLIVKEAYALGAHEVIVQWTDDVINREKFLHAPMERLDNVPEYKIAEMNYLLENKASRLGVRSSDPGALNGVDADKLSASAKAMGLAMKPMRIATQSNKVSWTVAAAAGLEWAKKVFPNAASDEEAVDFLWDQIFKTCRVYEADPVKAWEEHAAILKSKADMLNKEQFSALHYTAPGTDLTLGLPKNHVWESAGAVNAQGEEFLPNMPTEEVFTAPDFRRADGYVTSTKPLSYNGNIIEGIKVTFKDGQIVDITAEKGDQVMKDLVFENAGARALGECALVPDPSPISQSGITFFNTLFDENASNHLAIGAAYATSVVDGAEMSEEELEAAGLNRSDVHVDFMIGSNQMDIDGIREDGTRVPLFRNGNWAN

SEQ ID NO: 3620 - protein, 228 aa, Streptococcus pneumoniae
  misc_feature (B) LOCATION 1...228
  hypothetical: YES
DGEKKSSRVIERGHLMIELKNITKTIGGKVILDNLSLRIDQGDLVAIVGKSGSGKSTLLNLLGLIDGDYSGRYEIFGQTNLAVNSAKSQTIIREHISYLFQNFALIDDETVEYNLMLALKYVKLPKKDKLKKVEEILERVGLSATLHQRVSELSGGEQQRIAVARAILKPSQLILADEPTGSLDPENRDLVLKFLLEMNREGKTVIIVTHDAYVAQQCHRVIELGEGK

SEQ ID NO: 3621 - protein, 612 aa, Streptococcus pneumoniae
  misc_feature (B) LOCATION 1...612
  hypothetical: YES
QGEKHMSKIIGIDLGTTNSAVAVLEGTESKIIANPEGNRTTPSVVSFKNGEIIVGDAAKRQAVTNPDTVISIKSKMGTSEKVSANGKEYTPQEISAMILQYLKGYAEDYLGEKVTKAVITVPAYFNDAQRQATKDAGKIAGLEVERIVNEPTAAALAYGLDKTDKEEKILVFDLGGGTFDVSILELGDGVFDVLSTAGDNKLGGDDFDQKIIDHLVAEFKKENGIDLSTDKMAMQRLKDAAEKAKKDLSGVTSTQISLPFITAGEAGPLHLEMTLTRAKFDDLTRDLVERTKVPVRQALSDAGLSLSEIDEVILVGGSTRIPAVVEAVKAETGKEPNKSVNPDEVVAMGAAIQGGVITGDVKDVVLLDVTPLSLGIETMGGVFTKLIDRNTTIPTSKSQVFSTAADNQPAVDIHVLQGERPMAADNKTLGRFQLTDIPAAPRGIPQIEVTFDIDKNGIVSVKAKDLGTQKEQTIVIQSNSGLTDEEIDRMMKDAEANAESDKKRKEEVDLRNEVDQAIFATEKTIKETEGKGFDAERDAAQAALDDLKKAQEDNNLDDMKAKLEALNEKAQGLAVKLYEQAAAAQQAQEGAEGAQATGNAGDDVVDGEFTEK

SEQ ID NO: 3622 - protein, 195 aa, Streptococcus pneumoniae
  misc_feature (B) LOCATION 1...195
  hypothetical: YES
KGEKFMNKLMKFISVFLTSIVLIVSAIPSVSAVYASEQVSQIETNMELQPVTSLTEEQINTLANEIQSFHPDVSQQWIKEVINRQLQGDYTIPPTYSPFRAAWQGITVNQMGALLDTAIALALGGTTAGLANLIKVKGKHAAKSAIRSAISRYLGSWFVNDVALEFAMNLLSPGTYLAQLWDKNDAIPNNRRINF

SEQ ID NO: 3623 - protein, 87 aa, Streptococcus pneumoniae
  misc_feature (B) LOCATION 1...87
  hypothetical: YES
SLEKRNGNKQENEVSRMNLLSRIKNYFSEEVKETNLDWKEVALDLNQSLIETQEKLQEANQEIADLKKIVAIYKEKEKEKRWNIFTW

SEQ ID NO: 3624 - protein, 101 aa, Streptococcus pneumoniae
  misc_feature (B) LOCATION 1...101
  hypothetical: YES
EMEKLNALRKQKIRAVILLEAVVALAIFASIATLLLGQIQKNRQEEAKILQKEEVLRVAKMALQTGQNQVSINGVEIQVFSSEKGLEVYHGSEQLLAIKEP

SEQ ID NO: 3625 - protein, 118 aa, Streptococcus pneumoniae
  misc_feature (B) LOCATION 1...118
  hypothetical: YES
MKEKEFRRNMAVFPIGSVMKLTDLSARQIRYYEDQELIKPDRNEGNRRMYSLNDMDRLLEIKDYISEGYNIAAIKKKYAEREAKSKKAVSQTEVRRALHNELLQQGRFASVQSPFGRG

SEQ ID NO: 3626 - protein, 742 aa, Streptococcus pneumoniae
  misc_feature (B) LOCATION 1...742
  hypothetical: YES
KEENKLKIFKGEFYRISVLTDKLVRLEYSQTGSFEDRTTQLIYNRDFGQVSLDYIETSNVLDIMTDYFHLHFNKGEFNAENLFIELKGNFAVYGSRWYFGESIETLKGTARTLDKADGAISLEDGIISRNGIALLDDSQGFIWDEQSGYIERENQIDLYFFAYGHDYRGAIRDFYHLTGSTPLLPRYALGNWWSRYWPYTSDEYLDLIDRFETEKIPLSIGVLDMDWHITDIPARFGSGWTGYSWNRNLIPNPEQLLQQLHDRKLKLSLNVHPADGIRAYEEAYPQIAKRLGLNVELEEPAIFDFFNPSFREAYFKDVHYELEKQGVDFWWIDWQQGTQGMLDPLWLLNHYHYQDSCKNAEGGLILSRYAGPGSHRYPVGFSGDTIISWNSLRFQPYFTATASNIGYSWWSHDIGGHMLGDYDEELQTRWLQFGVFSPITRLHSSRSPFNSKEPWFFSETTSKIMKKYLRLRHQMIPYLYTMNVKTHEEGAPLISPIYYFYPENDESYNVPNQYFFGTELMVAPIVEKMDLTFQSAKVDVWFPEGEWYDFFSEKKYTGGVKLSVYRDISTTPVFAKSGAIIPLVGSEIGMGVDLPEVVDWYVFPGKQHSFEMLEDQNGQRYKTRLSIDWEMGMVELALQGDSSIVPSNRKHRIHFKGTNVSIIELPNKNDTAKFEWKDNKRTSLNDEVFRLLKTASLPYELKDRLLNQFINAKNSHDLMNILHHQDKELRGRLLEMIFTSQN

SEQ ID NO: 3627 - protein, 94 aa, Streptococcus pneumoniae
  misc_feature (B) LOCATION 1...94
  hypothetical: YES
LWENSYKEIVGEIDDETDKAAIDVHQIGEDTYIVQRTMTLNDFNNYFDVELXSDDVDTIAGYYLTGVGTIPTTEKLSYELVSQNKQFILTNDKV

SEQ ID NO: 3628 - protein, 83 aa, Streptococcus pneumoniae
  misc_feature (B) LOCATION 1...83
  hypothetical: YES
KQPLYNTFLGEKLTGFGFIPDGLSVKRTRNVFTVDTNLNLRVFRSDFPNYWCLIGALSSIWWCEGDISFFLRPIGVIFIFFLP

SEQ ID NO: 3629 - protein, 76 aa, Streptococcus pneumoniae
  misc_feature (B) LOCATION 1...76
  hypothetical: YES
MVRNKIGDLTNTLFAQLETLDDRDLTADELKVELQRSKQMVAISGQILQAGQLALDAEKFKDKVGEVNAPIALLEG

SEQ ID NO: 3630 - protein, 480 aa, Streptococcus pneumoniae
  misc_feature (B) LOCATION 1...480
  hypothetical: YES
IIRNEERKDTMAEERVEPKPIDLGEYKFGFHDDVEPVLSTGKGLNEGVIRELSAAKGEPEWMLEFRLKSYETFKKMPMQTWGADLSEIDFDDLIYYQKPSDKPARSWDDVPEKIKETFERIGIPEAERAYLAGASAQYESEVVYHNMKEEFQKLGIIFTDTDSALKEYPDLFKQYFAKLVPPTDNKLAALNSAVWSGGTFIYVPKGVKVDIPLQTYFRINNENIGQFERTLIIVDEGASVHYVEGCTAPTYSSNSLHAAIVEIFALDGAYMRYTTIQNWSDNVYNLVTKRAKAQKDATVEWIDGNLGAKTTMKYPSVYLDGEGARGTMLSIAFANAGQHQDTGAKMIHNAPHTSSSIVSKSIAKGGGKVDYRGQVTFNKNSKKSVSHIECDTIIMDDLSASDTIPFNEIHNSQVALEHEAKVSKISEEQLYYLMSRGLSESEATEMIVMGFVEPFTKELPMEYAVELNRLISYEMEGSVG

SEQ ID NO: 3631 - protein, 315 aa, Streptococcus pneumoniae
  misc_feature (B) LOCATION 1...315
  hypothetical: YES
LIRKYRMDIQFLGTGAGQPSKARNVSSLALKLLDEINEVWLFDCGEGTQNRILETTIRPRKVSKIFITHLHGDHIFGLPGFLSSRAFQANEEQTDLEIYGPQGIKSFVLTSLRVSGSRLPYRIHFHEFDQDSLGKILEIDKFTVYAEELDHTIFCVGYRVMQKDLEGTLDAEKLKAAGVPFGPLFGKIKNGQDLVLEDGTEIKAADYISAPRPGKIITILGDTRKTDASVRLAVNADVLVHESTYGKGDEKIARNHGHSTNMQAAQVAVEAGAKRLLLNHISARFLSKDISKLKKDAATIFENVHVVKDLEEVEI

SEQ ID NO: 3632 - protein, 262 aa, Streptococcus pneumoniae
  misc_feature (B) LOCATION 1...262
  hypothetical: YES
PTRNTARGQRVLYELRDRLKRNQFILNDTNPDIVISIGGDGMLLSAFHKYENQLDKVRFIGLHTGHLGFYTDYRDFELDKLVTNLQLDTGARVSYPVLNVKVFLENGEVKIFRALNEASIRRSDRTMVADIVINGVPFERFRGDGLTVSTPTGSTAYNKSLGGAVLHPTIEALQLTEIASLNNRVYRTLGSSIIVPKKDKIELIPTRNDYHTISVDNSVYSFRNIERIEYQIDHHKIHFVATPSHTSFWNRVKDAFIGEVDE

SEQ ID NO: 3633 - protein, 196 aa, Streptococcus pneumoniae
  misc_feature (B) LOCATION 1...196
  hypothetical: YES
FYRKLEEPVMTNTRRLSTIAILSAISFVLMYFDFPLLPAASFLKIEFSILPVLVGLVVMDLPAALGVLLLRSLLKLLLNSQGVNTYIGLPMNIVALGVFVIVFALIWKKERTTLRFLLGSLAGTVGLTLAMLVLNYVYAVPLYAKFANFDIGKILGLSNYLMTMVLPFNLIEGVIFSVSFWLLYVLLKPTLKHYER

SEQ ID NO: 3634 - protein, 460 aa, Streptococcus pneumoniae
  misc_feature (B) LOCATION 1...460
  hypothetical: YES
RYRKRFVIAKKKATFVCQNCGYNSPKYLGRCPNCGSWSSFVEEVEVAEVKNARVSLTGEKTKPMKLAEVTSINVNRTKTEMEEFNRVLGGGVVPGSLVLIGGDPGIGKSTLLLQVSTQLSQVGTVLYVSGEESAQQIKLRAERLGDIDSEFYLYAETNMQSVRAEVERIQPDFLIIDSIQTIMSPEISGVQGSVSQVREVTAELMQLAKTNNIAIFIVGHVTKEGTLAGPRMLEHMVDTVLYFEGERHHTFRILRAVKNRFGSTNEIGIFEMQSGGLVEVLNPSQVFLEERLDGATGSSIVVTMEGTRPILAEVQALVTPTMFGNAKRTTTGLDFNRASLIMAVLEKRAGLLLQNQDAYLKSAGGVKLDEPAIDLAVAVAIASSYKDKPTNPQECFVGELGLTGEIRRVNRIEQRINEAAKLGFTKIYVPQNSLTGITLPKEIQVIGVTTIQEVLKKVFA

SEQ ID NO: 3635 - protein, 776 aa, Streptococcus pneumoniae
  misc_feature (B) LOCATION 1...776
  hypothetical: YES
YNRNIDFKSKEEKMNALLNGMNDRQAEAVQTTEGPLLIMAGAGSGKTRVLTHRIAYLIDEKLVNPWNILAITFTNKAAREMKERAYSLNPATQDCLIATFHSMCVRILRRDADHIGYNRNFTIVDPGEQRTLMKRILKQLNLDPKKWNERTILGTISNAKNNLIDDVAYAAQAGDMYTQIVVQCYTAYQKELRQSESVDFDDLIMLTLRLFDQNPDVLTYYQQKFQYIHVDEYQDTNHAQYQLVKLLASRFKNICVVGDADQSIYGWRGADMQNILDFEKDYPKAKVVLLEENYRSTKTILQAANEVIKNNKNRRPKNLWTQNADGEQIVYYRADDELDEAVFVARTIDELSRSQNFLHKDFAVLYRTNAQSRTIEEALLKSNIPYTMVGGTKFYSRKEIRDIIAYLNLIANLSDNISFERIINEPKRGIGPGTVEKIRDFANLQNMSMLDASANIMLSGIKGKAAQSIWDFANMMLDLREQLDHLSITELVESVLEKTGYVDILNAQATLESKARVENIEEFLSVTKNFDDTTDVTEEETGLDKLSRFLNDLALIADTDSGSQETSEVTLMTLHAAKGLEFPVVFLIGMEENVFPLSRATEDPDELEEERRLAYVGITRAEKILYLTNANSRLLFGRTNYNRPTRFINEISSDLLEYQGLARPANTSFKASYSSGSISFGQGMSLAQALQDRKRGAAPKSIQSSGLPFGQFTAGAKPASSEANWSIGDIALHKKWGEGTVLEVSGSGARQELKINFPEVGLKKLLASVAPIEKKI

SEQ ID NO: 3636 - protein, 451 aa, Streptococcus pneumoniae
  misc_feature (B) LOCATION 1...451
  hypothetical: YES
YNRNMNLKTTLGLLAGRSSHFVLSRLGRGSTLPGKVALQFDKDILQNLAKNYEIVVVTGTNGKTLTTALTVGILKEVYGQVLTNPSGANMITGIATTFLTAKSSKTGKNIAVLEIDEASLSRICDYIQPSLFVITNIFRDQMDRFGEIYTTYNMILDAIRKVPTATVLLNGDSPLFYKPTIPNPIEYFGFDLEKGPAQLAHYNTEGILCPDCQGILKYEHNTYANLGAYICEGCGCKRPDLDYRLTKLVELTNNRSRFVIDGQEYGIQIGGLYNIYNALAAVAIARFLGADSQLIKQGFDKSRAVFGRQETFHIGDKECTLVLIKNPVGATQAIEMIKLAPYPFSLSVLLNANYADGIDTSWIWDADFEQITDMDIPEINAGGVRHSEIARRLRVTGYPAEKITETSNLEQVLKTIENQDCKHAYILATYTAMLEFRELLASRQIVRKEMN

SEQ ID NO: 3637 - protein, 233 aa, Streptococcus pneumoniae
  misc_feature (B) LOCATION 1...233
  hypothetical: YES
NCRNHLLNGGKTEMKLNKYIDHTLGKQDAQKKQIDSLLSEAREYDFASVCVNPTWVEHAKKGLEGTDVKVCTVVGFPLGATTSAVKAFETKEAIQNGADEIDMVINVGALKSGNLALVESDIRAVVEASGDKLVKVIIEACLLTDQEKIVVCQLAQKAGADFVKTSTGFSTGGATIADVRLMRETVGSDMGVKAAGGARSYADALAFVEAGATRIGTSAGVAILKGELADGDY

SEQ ID NO: 3638 - protein, 342 aa, Streptococcus pneumoniae
  misc_feature (B) LOCATION 1...342
  hypothetical: YES
VSRNMVKKIIGMVLALLSVTVVGVGVFAYTIYQQGTETLAKTYKKIGEETKVIEATEPLTILLMGVDTGNVERTETWVGRSDSMILMTVNPKTKKTTMMSLERDILTRIESGNGQAHEAKLNSAYADGGAELAIETIQKMMNIHIDRYVMVNMRGLQKLVDAVGGITVNNILGFPISISDQEEFNTISIGVGEQHIGGEEALVYARMRYQDPEGDYGRQKRQREVIQKVMEKALSLNSVGHYQEILKALSDNMQTNIDLSAKSIPNLLGYKDSFKTIETQQLQGEGEILQGVSYQIVSRAHMLEMQNILRRSLGQEEVTQLETNAVLFEDLFGRAPVGDEDN

SEQ ID NO: 3639 - protein, 245 aa, Streptococcus pneumoniae
  misc_feature (B) LOCATION 1...245
  hypothetical: YES
IFRKENLKLFYKFLLFDLDHTLLDFDAAENVALTQLLKEEGVADIQAYKDYYVPMNKALWKDLELKKISKQELVNTRFSRLFAHFGQEKDGSFLAQRYQFYLAQQGQTLSGAHDLLDSLIERDYNLYAATNGITAIQTGRLAQSGLAPYFNQVFISEQLQTQKPDALFYEKIGQQIAGFSKEKTLMIGDSLTADIQGGNNAGIDTIWYNPHHLENHTQAQPTYEVYSYQDLLDCLDKNILEKITF

SEQ ID NO: 3640 - protein, 219 aa, Streptococcus pneumoniae
  misc_feature (B) LOCATION 1...219
  hypothetical: YES
SVRNIQRKCKFDYLIRRETKMKVLVAEDQSMLRDAMCQLLTLQPDVESVLQAKNGQEAIQLLEKESVDIAILDVEMPVKTGLEVLEWIRSEKLETKVVVVTTFKRAGYFERAVKAGVDAYVLKERSIADLMQTLHTVLEGRKEYSPELMEMVMTRPNPLTEQEIAVLKGIARGLSNQEIADQLYLSNGTIRNYVTNILSKLDAGNRTEAANIAKESGWL

SEQ ID NO: 3641 - protein, 431 aa, Streptococcus pneumoniae
  misc_feature (B) LOCATION 1...431
  hypothetical: YES
GSRNNNFKKEKRHMHIFDELKDRGLIFQTTDEEALRKALEEGQVSYYTGYDPTADSLHLGHLVAILTSRRLQLAGHKPYALVGGATGLIGDPSFKDAERSLQTKDTVDGWVKSIQGQLSRFLDFENGENKAVMVNNYDWFGSISFIDFLRDIGKYFTVNYMMSKESVKKRIETGISYTEFAYQIMQGYDFFVLNQDHNVTLQIGGSDQWGNMTAGTELLRRKADKTGHVITVPLITDATGKKFGKSEGNAVWLNPEKTSPYEMYQFWMNVMDADAVRFLKIFTFLSLDEIEDIRKQFEAAPHERLAQKVLAREVVTLVHGEEAYKEALNITEQLFAGNIKNLSVKELKQGLRGVPNYQVQADENNNIVELLVSSGIVNSKRQAREDVQNGAIYVNGDRIQELDYVLSDADKLENELTVIRRGKKKYFVLTY

SEQ ID NO: 3642 - protein, 87 aa, Streptococcus pneumoniae
  misc_feature (B) LOCATION 1...87
  hypothetical: YES
PYRKRQQIMKMSTFFKKSFWPTFMIVNQTVILFHLKDGLDRQYLTTESIYWVIGTFIFGNILVAVFSNMKIWDKKKNGSKKKYILKK

SEQ ID NO: 3643 - protein, 135 aa, Streptococcus pneumoniae
  misc_feature (B) LOCATION 1...135
  hypothetical: YES
TLRNLLTDKILALDFLRNKIWYSSSMNYEASKQLTDARFKCLVGVQRTTFEEILAVLKTAYQLKHTKGGREPKLSLEDLLMATLQYVREYRTYEQIAAVFGIHESNLLRRSQWVEVTLVQSILQFQELLSVLRTR

SEQ ID NO: 3644 - protein, 304 aa, Streptococcus pneumoniae
  misc_feature (B) LOCATION 1...304
  hypothetical: YES
FLRNQSLPSRLDSRKSQITLGEIFKRVGAEVEIDESYTAPFVMAHFKSSRPDAKTLIFYNHYDTVPADGDQVWTEDPFTLSVRNGFMYGRGVDDDKGHITARLSALRKYMQHHDDLPVNISFIMEGAEESASTDLDKYLEKHADKLHGADLLVWEQGTKNALEQLEISGGNKGIVTFDAKVKSADVDIHSSYGGVVESAPWYLLQALQSLRAADGRILVEGLYEEVHEPNEREMALLETYGQRNPEEVSRIYGLELPLLQEERMAFLKRFFFEPALNIEGIQSGYQGQGVKTIVPAEASAKLEV

SEQ ID NO: 3645 - protein, 148 aa, Streptococcus pneumoniae
  misc_feature (B) LOCATION 1...148
  hypothetical: YES
NKRKKLTKETGMEHTFFIIKPDGVKRGLVGEVLKRIEQRGFTIEKLEFRSQVSEELIDQHYQDLVGQSFYPPIREFMTSGPVLVGVISGPKVIETWRTMMGATRPEEALPGTIRGDFAKAAGENEIIQNVVHGSDSEESAKREIALWF

SEQ ID NO: 3646 - protein, 182 aa, Streptococcus pneumoniae
  misc_feature (B) LOCATION 1...182
  hypothetical: YES
QKRKQFTKKNDGGANMAQKGVSLIKAAFDTDNFLMRFSEKVLDIVTANLLFVVSCLPIVTIGVAKISLYETMFEVKKSRRVPVFKIYLRSFKQNLKLGLQLGLMELGIVFLTLSDLYLFWGQTALPFQLLKAICLGILIFLTIVMLASYPIAARYDLSWKEILQKGLMLASFNYPALHHEWN

SEQ ID NO: 3647 - protein, 151 aa, Streptococcus pneumoniae
  misc_feature (B) LOCATION 1...151
  hypothetical: YES
KKRKIWPARFLIIMAIRTSFLIKCISFLREVGKMTEINWKDNLRIAWFGNFLTGASISLVVPFMPIFVENLCVGSQQVAFYAGLAISVSAISAALFSPIWGILADKYGRKPMMILGRSCYDYHYGRLGLCPKYLLVNLSSFTKRCICRFCS

SEQ ID NO: 3648 - protein, 194 aa, Streptococcus pneumoniae
  misc_feature (B) LOCATION 1...194
  hypothetical: YES
YRRKGIRKNMANVIIEKAKERMTQSHQSLAREFGGIRAGRANASLLDRVHVEYYGVETPLNQIASITIPEARVLLVTPFDKSSLKDIERALNASDLGITPANDGSVIRLVIPALTEETRRDLAKEVKKVGENAKVAVRNIRRDAMDEAKKQEKAQEITEDELKTLEKDIQKVTDDAVKHIDDMTANKEKELLEV

SEQ ID NO: 3649 - protein, 118 aa, Streptococcus pneumoniae
  misc_feature (B) LOCATION 1...118
  hypothetical: YES
GGRKMKSKEEINMLGFTIVAYAGDARSDLMDALAFARDGYFEQARELVESANDSIVSAHREQTNLLAEEASGDNFEVSFIMIHGQDTLMTTMLLYDQVKFFIDEYERIRKIEEHIGLQ

SEQ ID NO: 3650 - protein, 282 aa, Streptococcus pneumoniae
  misc_feature (B) LOCATION 1...282
  hypothetical: YES
NKRKNSIKEEIMEKQTVAVLGPGSWGTALSQVLNDNGHEVRIWGNLPEQINEINTHHTNKHYFKDVVLDENIIAYTDLAETLKDVDAILFVVPTKVTRLVAQQVAQTLDHKVIIMHASKGLEPDSHKRLSTILEEEIPEHLRSDIVVVSGPSHAEETIVRDLTLITAASKDLQTAQYVQELFSNHYFRLYTNTDVIGVETAGALKNIIAVGAGALHGLGFGDNAKAAIIARGLAEITRLGVALGASPLTYSGLSGVGDLIVTGTSIHSRNWRAGDALGRGES

SEQ ID NO: 3651 - protein, 91 aa, Streptococcus pneumoniae
  misc_feature (B) LOCATION 1...91
  hypothetical: YES
EKRKEMYYTLEEKEVFMREALREAEIALEHDEIPIGCVIVKDGEIIGRGHNAREELQRAVMHAEIMAIEDANLSEESWRLLDCTLFVTVQH

SEQ ID NO: 3652 - protein, 88 aa, Streptococcus pneumoniae
  misc_feature (B) LOCATION 1...88
  hypothetical: YES
KERKMVYLVLGILLLLLYVFATPESIKGTVNIVAMVCILVALLILLVLSFLKIFQLPTEIFLAIAMLILAYFSVRDITLMPVKKSKRR

SEQ ID NO: 3653 - protein, 201 aa, Streptococcus pneumoniae
  misc_feature (B) LOCATION 1...201
  hypothetical: YES
ARRKLTTNKNSRIQAEKERKKRDKIAKQYADNLVLAMGPAERAYQDYFGFTETLTQEERKWEKILFGKNRAERAIKAKQYQKELEKDQRIASQDPIERKQKQTWLLNSYFRELPEEKARFSRLLLEYRKNGEVPFSTEYLSDHLIDFFYKMKAFEFEIAPEQVRDFLKKSLQEDYRSSAQGSWIEGILLNCLKPFLERLVI

SEQ ID NO: 3654 - protein, 98 aa, Streptococcus pneumoniae
  misc_feature (B) LOCATION 1...98
  hypothetical: YES
KRRNKMVKVLAACGNGMGSSMVIKMKVENALRKLNQTDFTVNSCSVGEAKGLAVGYDIVIASLHLIQELEGRTNGKLIGLDNLMDDKEITEKLSQALQ

SEQ ID NO: 3655 - protein, 227 aa, Streptococcus pneumoniae
  misc_feature (B) LOCATION 1...227
  hypothetical: YES
KRRKKMKKFVAELIGTFMLVFVGTGAVVFGNGLDGLGHLGIAFAFGLAIVVAAYSIGTVSGAHLNPAVSIAMFVNKRLSSSELVNYILGQVVGAFIASGAVFFLLANSGMSTASLGENALANGVTVFGGFLFEVIATFLFVLVIMTVTSESKGNGAIAGLVIGLSLMAMILVGLKITGLSVNPARSLAPAVLVGGAALQQVWIFILAPIAGGVLAALVAKNFLGTEE

SEQ ID NO: 3656 - protein, 419 aa, Streptococcus pneumoniae
  misc_feature (B) LOCATION 1...419
  hypothetical: YES
YNGKNKFKRSFFMTYPNLLDRFLTYVKVNTRSDEHSTTTPSTQSQVDFATNVLIPEMKRVGLQNVYYLPNGFAIGTLPANDPSLTRKIGFISHMDTADFNAEGVNPQVIENYDGGVIELGNSGFKLDPADFKSLEKYPGQTLITTDGTTLLGADDKSGIAEIMTAIEYLTAHPEIKHCEIRVGFGPDEEIGVGANKFDAEDFDVDFAYTVDGGPLGELQYETFSAAGAELHFQGRNVHPGTAKGQMVNALQLAIDFHNQLPENDRPELTEGYQGFYHLMDVTGSVEEARASYIIRDFEKDAFEARKASMQSIADKMNEELGSNRVTLNLTDQYYNMKEVIEKDMTPITVAKAVMEDLGITPIIEPIRGGTDGSKISFMGIPTPNIFAGGENMHGRFEYVSLQTMERAVDTIIGIVAYKG

SEQ ID NO: 3657 - protein, 263 aa, Streptococcus pneumoniae
  misc_feature (B) LOCATION 1...263
  hypothetical: YES
EDGNMKKNSLYIISSLFFACVLFVYATATNFQNSTSARQVKTETYTNTVTNVPIDIRYNSDKYFISGFASEVSVVLTGANRLSLASEMQESTRKFKVTADLTDAGVGTIEVPLSIEDLPNGLTAVATPQKITVKIGKKAQKDKVKIVPEIDPSQIDSRVQIENVMVSDKEVSITSDQETLDRIDKIIAVLPTSERITGNYSGSVPLQAIDRNGVVLPAVITPFDTIMKVTTKPVAPSSSTSNSSTSSSSETSSSTKATSSKTN

SEQ ID NO: 3658 - protein, 158 aa, Streptococcus pneumoniae
  misc_feature (B) LOCATION 1...158
  hypothetical: YES
NKGKGERRMKVIFLADVKGKGKKGEIKEVPTGYAQNFLIKKNLAKEATAQAVGELRGKQKSEEKAHAEMIAEGKAIKAQLEAEETVVEFVEKVGPDGRTFGSITNKKIAEELQKQFGIKIDKRHIQVQAPIRAVGLIDVPVKIYQDITSVINLRVKEG

SEQ ID NO: 3659 - protein, 521 aa, Streptococcus pneumoniae
  misc_feature (B) LOCATION 1...521
  hypothetical: YES
LKGNTMEEQSEIVRSKKEFAFASSTILSQVGRGIIVGLIVGIIVGSFRFLIEKGFHLIQGVYQDQGYLVRNLFVLVLFYILICWLSAKLTRSEKDIKGSGIPQVEAELKGLMSLNWWGILWKKYVLGILAIASGLMLGREGPSIQLGAVGGKGIAKWLKSSPVEERSLIASGAAAGLAAAFNAPIAALLFVVEEVYHHFSRFFWVSTLAASIVANFVSLLMFGLTPVLDMPDNIPPMTLDQYWIYLVMGIFLGFSGFLYEKAVLNVGRVYDLIGQKIHLDRAYYPILAFILIIPVGIFLPQILGGGNQLVLSLTEQNFSFQVLLAYFLIRFIWSMISYGSGLPGGIFLPILALGSLLGALVGVICVNLGLVSQEQFPIFVILGMSGYFGSISKAPLTAMILVTEMVGDIRNLMPLGLVTLVSYIIMDLLKGTPVYEAMLEKMLPEEVSSEGEVTLIEIPVSDKIAGKQVHELNLPHNVLITTQVHNGKSQTVNGSTRMYLGDMIHLVIPKSEIGKVKDLLL

SEQ ID NO: 3660 - protein, 422 aa, Streptococcus pneumoniae
  misc_feature (B) LOCATION 1...422
  hypothetical: YES
VGGNMKAEIIAVGTEILTGQIVNTNAQFLSEKLAEIGVDVYFQTAVGDNEVRLLSLLEIASQRSSLVILTGGLGPTEDDLTKQTLAKFLGKALVFDPQAQEKLDIFFALRPDYARTPNNERQAQIVEGAIPLPNETGLAVGGKLEVDGVTYVVLPGPPSELKPMVLNQLLPKLMTGSKLYSRVLRFFGIGESQLVTILADLIDNQIDPTLAPYAKTGEVTLRLSTKASSQEEANQALDILENQILDCQTFEGISLRDFCYGYGEETSLASIVVEELKRQGKTIAAAESLTAGLFQATVANFSGASSIFKGGFVTYSLEEKSRMLDIPAKNLEEHGVVSEFTAQKMAEQARSKTQSDFGISLTGVAGPDSLEGHPVGTVFIGLAQEQGTEVIKVNIGGRSRADVRHIAVMHAFNLVRKALLSD

SEQ ID NO: 3661 - protein, 67 aa, Streptococcus pneumoniae
  misc_feature (B) LOCATION 1...67
  hypothetical: YES
KMGKKKENQIEKLPLYLEKLLKLSILKSSMGQSENVLEKGASKRFILPTMLNSLMKIIASTRSRDQA

SEQ ID NO: 3662 - protein, 81 aa, Streptococcus pneumoniae
  misc_feature (B) LOCATION 1...81
  hypothetical: YES
VGGKSRAFILAEGTRMGHIHLSVKDSRKSSQFYQKVLGLENKFSVPGASWIAAGDYHHHLAVNEWGGKGLASRKQGLPGLA

SEQ ID NO: 3663 - protein, 89 aa, Streptococcus pneumoniae
  misc_feature (B) LOCATION 1...89
  hypothetical: YES
KQCFEQPAASCLVCSLIFIEFHSTVTYGQMLILLFFYAISNFNWPALTPILSVLPATKSPLRRSSANLSSTSVCRVLRSGRAPISGSYP

SEQ ID NO: 3664 - protein, 219 aa, Streptococcus pneumoniae
  misc_feature (B) LOCATION 1...219
  hypothetical: YES
GECLGILGINGAGKTSTLKMIYSLTSISSGEIDILGQNIETNRRKSKSCLGIVGQEDMLDMTLNVYDNLFAHGLCYGISSVELRKRIDSLLDFVQLSKHAQKMVNQLSSGMRRRLVLARALINRPDIIILDEPTVGLDIQSRNIIWDKLLELKELGVSIIITSHYMNEIEYLTDRVLMLHQGTIKEEGTVEDLLIKYDADNLETLFLGLTGTEKEDLHV

SEQ ID NO: 3665 - protein, 130 aa, Streptococcus pneumoniae
  misc_feature (B) LOCATION 1...130
  hypothetical: YES
SSLKIFPSFNINARSVFEANSISCVTIITHLPAPTNSLNKSKITSRETLSKAPVGSSANIISLSAINALAIATFCCSPPDRVPTKSFKPALNFILLSKFSTFLIVNFFCDNRKGSAIFSITGREGIKLYA

SEQ ID NO: 3666 - protein, 178 aa, Streptococcus pneumoniae
  misc_feature (B) LOCATION 1...178
  hypothetical: YES
KTLKERKKMNLKDYIATIENYPKEGITFRDISPLMADGNAYSYAVREIVQYATDKKVDMIVGPEARGFIVGCPVAFELGIGFAPVRKPGKLPREVISADYEKEYGVDTLTMHADAIKPGQRVLIVDDLLATGGTVKATIEMIEKLGGVMAGCAFLVELVELNGREKIGDYDYKVLMHY

SEQ ID NO: 3667 - protein, 63 aa, Streptococcus pneumoniae
  misc_feature (B) LOCATION 1...63
  hypothetical: YES
RSLNWIFAECKLLKLGCHTMYTTWALVVANCTKYNIRRVLWGKAIGIGKEFIAFVSLLWELAQ

SEQ ID NO: 3668 - protein, 64 aa, Streptococcus pneumoniae
  misc_feature (B) LOCATION 1...64
  hypothetical: YES
RGLKRFSKSIRRKRMKEIAFDAFYQLYQNDQLSLVDVREVDEFAALHLEGAHNLPLSQLADSYD

SEQ ID NO: 3669 - protein, 175 aa, Streptococcus pneumoniae
  misc_feature (B) LOCATION 1...175
  hypothetical: YES
RGLKRFLKSINKGVQEVRLILYEKQGEKFMKVELQISETYEEEKLIVQAPQPTDKVQKVIEFAENLDQREKIKGKSDDQVYLVEIGKIQRFYIENRKVLAETASQTYSIDLRLYQVPKLLPSNFIQISQSEIINIDSISHLKLTPNGLVEIFLKNESFTYSSRRYLKTIKEKLEL

SEQ ID NO: 3670 - protein, 139 aa, Streptococcus pneumoniae
  misc_feature (B) LOCATION 1...139
  hypothetical: YES
RGLKRFSKSIILDSNQKALYNSNMKSTKEEIQTIKTLLKDSRTAKYHKRLQIVLFRLMGKSYKEIIELLDCNQTTIWRNVKKYEEFGLDSLLQETRGGRNHAYMTVEEEKAFLARHLKATEAGEFVTIPYFRLISFLHT

SEQ ID NO: 3671 - protein, 228 aa, Streptococcus pneumoniae
  misc_feature (B) LOCATION 1...228
  hypothetical: YES
RGLKRFSKSISTFFEIGASMKIHKTVNPVAYENTYYLEGEKHLIVVDPGSHWEAIRQTIEKINKPICAILLTHAHYDHIMSLDLVRETFGNPPVYIAESEASWLYTPVDNLSGLPRHDDMADVVTKPAEHTFVFHEEYQLEEFRFKVLPTPGHSIGGVSLVFPDAHLVLTGDALFRETIGRTDLPTGSMEQLLHSIQTQLFTLPNYDVYPGHGPATTIAHEKAFNPFF

SEQ ID NO: 3672 - protein, 78 aa, Streptococcus pneumoniae
  misc_feature (B) LOCATION 1...78
  hypothetical: YES
VLLKFFVSQINCWQRCMRRGAHQLFFLDIEIRHEEMKGLDVARKIRDRDSYALIVLVTSSLEVYAPVLSLPSVCSGLY

SEQ ID NO: 3673 - protein, 63 aa, Streptococcus pneumoniae
  misc_feature (B) LOCATION 1...63
  hypothetical: YES
LLLKWNGAREKLSTKTVPRLTKKSKSRRRYLNPVVKKIKEDVRGITDLPHPIFTGFDCLKYNQ

SEQ ID NO: 3674 - protein, 63 aa, Streptococcus pneumoniae
  misc_feature (B) LOCATION 1...63
  hypothetical: YES
FSLNKKKKKKKKKKKKKWGKKNKKKKKKKKKKKKKKKREKKKKREKRRGGRKRGGRERRKKEG

SEQ ID NO: 3675 - protein, 83 aa, Streptococcus pneumoniae
  misc_feature (B) LOCATION 1...83
  hypothetical: YES
NALKKLLPFVVFQFLIWHKKGDKMAQIKITLTKSPIGRIPSQRKTVVALGLGKLNSSVIKEDNAAIRGMITAVSHLVTVEEVN

SEQ ID NO: 3676 - protein, 1769 aa, Streptococcus pneumoniae
  misc_feature (B) LOCATION 1...1769
  hypothetical: YES
KFMNKGLFEKRCKYSIRKFSLGVASVMIGAAFFGTSPVLADSVQSGSTANLPADLATALATAKENDGRDFEAPKVGEDQGSPEVTDGPKTEEELLALEKEKPAEEKPKEDKPAAAKPETPKTVTPEWQTVEKKEQQGTVTIREEKGVRYNQLSSTAQNDNAGKPALFEKKGLTVDANGNATVDLTFKEDSEKGKSRFGVFLKFKDTNNNVFVGYDKDGWFWEYKSPTTSTWYRGSRVAAPETGSTNRLSITLKSDGQLNASNNDVNLFDTVTLPAAVNDHLKNEKKILLKAGSYDDERTVVSVKTDNQERVKTEDTPAQKETGPVVDDRKVTYDTIQSKVLKAVIDQAFPRVKEYTLNGHTLPGQVQQFNQVFINNHRITPEVTYKKINETTAEYLMKLRDDAHLINAEMTVRLQVVDNQLHFDVTKIVNHNQVTPGQKIDDERKLLSSISFLGNALVSVSSDQTGAKFDGATMSNNTHVSGDDHIDVTNPMKDLAKGYMYGFVSTDKLAAGVWSNSQNSYGGGSNDWTRLTAYKETVGNANYVGIHSSEWQWEKAYKGIVFPEYTKELPSAKVVITEDANADKKVDWQDGAIAYRSIMNNPQGWEKVKDITAYRIAMNFGSQAQNPFLMTLDGIKKINLHTDGLGQGVLLKGYGSEGHDSGHLNYADIGKRIGGVEDFKTLIEKAKKYGAHLGIHVNASETYPESKYFNEKILRKNPDGSYSYGWNWLDQGINIDAAYDLAHGRLARWEDLKKKLGDGLDFIYVDVWGNGQSGDNGAWATHVLAKEINKQGWRFAIEWGHGGEYDSTFHHWAADLTYGGYTNKGINSAITRFIRNHQKDAWVGDYRSYGGAANYPLLGGYSMKDFEGWQGRSDYNGYVTNLFAHDVMTKYFQHFTVSKWENGTPVTMTDNGSTYKWTPEMRVELVDADNNKVVVTRKSNDVNSPLYRERTVTLNGRVIQDGSAYLTPWNWDANGKKLSTDKEKMYYFNTQAGATTWTLPSDWAKSKVYLYKLTDQGKTEEQELTVKDGKITLDLLANQPYVLYRSKQTNPEMSWSEGMHIYDQGFNSGTLKHWTISGDASKAEIVKSQGANDMLRIQGNKEKVSLTQKLTGLKPNTKYAVYVGVDNRSNAKASITVNTGEKEVTTYTNKSLALNYVKAYAHNTRRNNATVDDTSYFQNMYAFFTTGSDVSNVTLTLSREAGDQATYFDEIRTFENNSSMYGDKHDTGKGTFKQDFENVAQGIFPFVVGGVEGVEDNRTHLSEKHDPYTQRGWNGKKVDDVIEGNWSLKTNGLVSRRNLVYQTIPQNFRFEAGKTYRVTFEYEAGSDNTYAFVVGKGEFQSGRRGTQASNLEMHELPNTWTDSKKAKKATFLVTGAETGDTWVGIYSTGNASNTRGDSGGNANFRGYNDFMMDNLQIEEITLTGKMLTENALKNYLPTVAMTNYTKESMDALKEAVFNLSQADDDISVEEARAEIAKIEALKNALVQKKTALVADDFESLDAPAQPGEGLENAFDGNVSSLWHTSWNGGDVGKPATMVLKEPTEITGLRYVPRGSGSNGNLRDVKLVVTDESGKEHTFTATDWPDNNKPKDIDFGKTIKAKKIVLTGTKTYGDGGDKYQSAAELIFTRPQVAETPLDLLGYEAALAKAQKLTDKDNQEEVASVQASMKYATDNHLLTERMVEYFADYLNQLKDSATKPDAPTVEKPEFKLSSLASEQGKTPDYKQEIARPETPEQILPATGESQSDTALFLAGVSLALSALFVVKTKKD

SEQ ID NO: 3677 - protein, 618 aa, Streptococcus pneumoniae
  misc_feature (B) LOCATION 1...618
  hypothetical: YES
ISMNKKLTDYVIDLVEILNKQQKQVFWGIFDIFSMVVSIIVSYILFYGLINPAPVDYIIYTSLAFLFYQLMIGFWGLNASISRYSKITDFMKIFFGVTASSVLSYSICYAFLPLFSIRFIILFILLSTFLILLPRITWQLIYSRRKKGSGDGEHRRTFLIGAGDGGALFMDSYQHPTSELELVGILDKDSKKKGQKLGGIPVLGSYDNLPELAKRHQIERVIVAIPSLDPSEYERILQMCNKLGVKCYKMPKVETVVQGLHQAGTGFQKIDITDLLGRQEIRLDESRLGAELTGKTILVTGAGGSIGSEICRQVSRFNPERIVLLGHGENSIYLVYHELIRKFQGIDYVPVIADIQDYDRLLQVFEQYKPAIVYHAAAHKHVPMMERNPKEAFKNNIRGTYNVARAVDEAKVSKMVMISTDKAVNPPNVMGATKRVAELIVTGFNQRSQSTYCAVRFGNVLGSRGSVIPVFERQIAEGGPVTVTDFRMTRYFMTIPEASRLVIHAGAYAKDGEVFILDMGKPVKIYDLAKKMVLLSGHTESEIPIVEVGIRPGEKLYEELLVSTELVDNQVMDKIFVGKVNVMPLESINQKIGEFRTLSGDELKQAIIAFANQTTHIE

SEQ ID NO: 3678 - protein, 437 aa, Streptococcus pneumoniae
  misc_feature (B) LOCATION 1...437
  hypothetical: YES
YPMKGVNMEKQQPSKAALLSIIPGLGQIYNKQKAKGFIFLGVTIVFVLYFLALATPELSNLITLGDKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVGLTNFTNIWSLSTFRSAFGSVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMVAFKKLHAFDMEDV

SEQ ID NO: 3679 - protein, 218 aa, Streptococcus pneumoniae
  misc_feature (B) LOCATION 1...218
  hypothetical: YES
NTMKDKQTFLMKGSFALLLFVILGYMVKFYPEMLVNFDQSIQTAIRGNLPNYLTILFRSLTRLIDIPVIITWVVITAFVFYRKRWKIKSFFMLGNLALAGLLIVTFKNIYQRPQPAILHLVEEKGFSFPSGHSLAVTLMVGTLIVILSQRIKDPVWRKIVQIVLGLYLVSVLVSRVYLGVHYPSDVLASLCVGLGVLFIEFPFYDKLRFQWRFKGKQK

SEQ ID NO: 3680 - protein, 120 aa, Streptococcus pneumoniae
  misc_feature (B) LOCATION 1...120
  hypothetical: YES
NHMNITNLFSIKTGCDETDRQLQKLFFQLDLQLGELTDQLRKLDSNFVPRSQFVDTLDLNDVEYKEILNYFIFHRNDSEESLVEWLYDWISTNRYELPKEFSIRMAHKYHESVTEVFGDE

SEQ ID NO: 3681 - protein, 81 aa, Streptococcus pneumoniae
  misc_feature (B) LOCATION 1...81
  hypothetical: YES
TNMKRIAVLTSGGDAPGMNAAIRAVVRQAISEGMEVFGIYDGYAGMVAGENSSPKCSFSRGHHFSWWYFSSLSSLSKFRST

SEQ ID NO: 3682 - protein, 155 aa, Streptococcus pneumoniae
  misc_feature (B) LOCATION 1...155
  hypothetical: YES
DNMKQTKTTKIALVSLLTALSVVLGYFLKFPTPTGILTLLDAGVFFAAFYFGSREGAVVGGLASFLIDLLSGYPQWMFFSLVNHGLQGFFAGFKGKSQWLGLILATIAMVGGYALGSTLMNGWAAALPEILPNFMQNMVGMIVGFILSQSIKKIK

SEQ ID NO: 3683 - protein, 163 aa, Streptococcus pneumoniae
  misc_feature (B) LOCATION 1...163
  hypothetical: YES
ISMNLNDIKDLMTQFDQSSLREFSYKNGTDELQFSKNEARPVPEVATQVAPAPVLATPSPVAPTSAPAETVAEEVPAPAEASVASEGNLVESPLVGVVYLAAGPDKPAFVTVGDSVKKGQTLVIIEAMKVMNEIPAPKDGVVTEILVSNEEMVEFGKGLVRIK

SEQ ID NO: 3684 - protein, 434 aa, Streptococcus pneumoniae
  misc_feature (B) LOCATION 1...434
  hypothetical: YES
RSMKVNLDYLGRLFTENELTEEERQLAEKLPAMRKEKGKLFCQRCNSTILEEWYLPIGAYYCRECLLMKRVRSDQTLYYFPQEDFPKQDVLKWRGQLTPFQEKVSEGLLQAVDKQKPTLVHAVTGAGKTEMIYQVVAKVINAGGAVCLASPRIDVCLELYKRLQQDFSCGIALLHGESEPYFRTPLVVATTHQLLKFYQAFDLLIVDEVDAFPYVDNPMLYHAVKNSVKENGLRIFLTATSTNELDKKVRLGELKRLNLPRRFHGNPLIIPKPIWLSDFNRYLDKNRLSPKLKSYIEKQRKTAYPLLIFASEIKKGEQLAEILQEQFPNEKIGFVSSVTEDRLEQVQAFRDGELTILISTTILERGVTFPCVDVFVVEANHRLFTKSSLIQIGGRVGRSMDRPTGDLLFFHDGLNASIKKAIKEIQMMNKEAGL

SEQ ID NO: 3685 - protein, 313 aa, Streptococcus pneumoniae
  misc_feature (B) LOCATION 1...313
  hypothetical: YES
RSMKWTKIIKKIEEQIEAGIYPGASFAYFKDNQWTEFYLGQSDPEHGLQTEAGLVYDLASVSKVVGVGTVCTFLWEIGQLDIDRLVIDFLPESDYPDITIRQLLTHATDLDPFIPNRDLLTAPELKEAMFHLNRRSQPAFLYSDVHFLLLGFILERIFNQDLDVILKDQVWKPWGMTETKFGPVELAVPTVRGVEAGIVHDPKARLLGRHAGSAGLFSTIKDLQIFLEHYLADDFARDLNQNFSPLDDKERSLAWNLEGDWLDHTGYTGTFIMWNRQKQEATIFLSNRTYEKDERAQWILDRNQVMNLIRKEE

SEQ ID NO: 3686 - protein, 160 aa, Streptococcus pneumoniae
  misc_feature (B) LOCATION 1...160
  hypothetical: YES
LLMKWTALPVRSSKKLVMVSTSTTVSGMVSVWMSMNSHLSWKETTWSSKKACASLLNQVSISLVKSVFVLKTAVLLPRMASTSLQAPAKICFILIKLYSPYAFLSKYLGAILLSFFCYYAKEIGCNNLTLSVWNDNEGALRFYQRQGMKPQETTMEMIID

SEQ ID NO: 3687 - protein, 654 aa, Streptococcus pneumoniae
  misc_feature (B) LOCATION 1...654
  hypothetical: YES
SLMKKQNNGLIKNPFLWLLFIFFLVTGFQYFYSGNNSGGSQQINYTELVQEITDGNVKELTYQPNGSVIEVSGVYKNPKTSKEGTGIQFFTPSVTKVEKFTSTILPADTTVSELQKLATDHKAEVTVKHESSSGIWINLLVSIVPFGILFFFLFSMMGNMGGGNGRNPMSFGRSKAKAANKEDIKVRFSDVAGAEEEKQELVEVVEFLKDPKRFTKLGARIPAGVLLEGPPGTGKTLLAKAVAGEAGVPFFSISGSDFVEMFVGVGASRVRSLFEDAKKAAPAIIFIDEIDAVGRQRGVGLGGGNDEREQTLNQLLIEMDGFEGNEGIIVIAATNRSDVLDPALLRPGRFDRKVLVGRPDVKGREAILKVHAKNKPLAEDVDLKLVAQQTPGFVGADLENVLNEAALVAARRNKSIIDASDIDEAEDRVIAGPSKKDKTVSQKERELVAYHEAGHTIVGLVLSNARVVHKVTIVPRGRAGGYMIALPKEDQMLLSKEDMKEQLAGLMGGRVAEEIIFNVQTTGASNDFEQATQMARAMVTEYGMSEKLGPVQYEGNHAMLGAQSPQKSISEQTAYEIDEEVRSLLNEARNKAAEIIQSNRETHKLIAEALLKYETLDSTQIKALYETGKMPEAVEEESHALSYDEVKSKMNDEK

SEQ ID NO: 3688 - protein, 214 aa, Streptococcus pneumoniae
  misc_feature (B) LOCATION 1...214
  hypothetical: YES
QLMNFETVIGLEVHVELNTNSKIFSPTSAHFGNDQNANTNVIDWSFPGVLPVLNKGVVDAGIKAALALNMDIHKKMHFDRKNYFYPDNPKAYQISQFDEPIGYNGWIEVELEDGTTKKIGIERAHLEEDAGKNTHGTDGYSYVDLNRQGVPLIEIVSEADMRSPEEAYAYLTALKEVIQYAGISDVKMEEGSMRVDANISLVLMVKRNSVPRLN

SEQ ID NO: 3689 - protein, 432 aa, Streptococcus pneumoniae
  misc_feature (B) LOCATION 1...432
  hypothetical: YES
PIMKSDKTIIRKIHMEQLHFITKLLDIKDPNIKILDIINMDTHKEIIAKLDYEAPSCPDCGSLMKKYDFQKPSKIPYLETTGMPSRILLRKRRFKCYHCSKMMVAETPLVKKNHQIPRIINQKIAQKLIEKISMTDIAHQLAISTSTVIRKLNDFHFEHDFSRLPKIMSWDEYAFTKGKMSFIAQDFDNLNIITVLEGRTQAVIRNHFLRYDRAVRCQVKIITMDMFSPYYDLAKQLFPCAKIVLDRFHIIQHLSRAMSRFRVQIMNQFERKSHEYKAIKRYWKLIQQDSRKLSDKRFYRPTFRMHLTNKEILDKILSYSEDLKHHYQIYQLLLFHFQNKDPEKFFGLIEDTLKQVHPIFQTVFKTFLKNKEKIVNALQLPYSNAKLEATNNLIKLIKRNAFGFRNFENFKKRIFIALNIKKERTNFVLSRA

SEQ ID NO: 3690 - protein, 426 aa, Streptococcus pneumoniae
  misc_feature (B) LOCATION 1...426
  hypothetical: YES
KIMKISWNGFSKKSYQERLELLKAQALLSPERQASLEKDEQMSVTVADQLSENVVGTFSLPYSLVPEVLVNGQEYTVPYVTEEPSVVAAASYASKIIKRAGGFTAQVHQRQMIGQVALYQIANPKLAQEKIASKKAELLELANQAYPSIVKRGGGARDLHVEQIKGEPDFLVVYIHVDTQEAMGANMLNTMLEALKPVLEELSQGQSLMGILSNYATDSLVTASCRIAFRYLSRQKDQGREIAEKIALASQFAQADPYRAATHNKGIFNGIDAILIATGNDWRAIEAGAHAFASRDGRYQGLSCWTLDLEREELVGEMTLPMPVATKGGSIGLNPRVALSHDLLGNPSARELAQIIVSIGLAQNFAALKALVSTGIQQGHMKLQAKSLALLAGASESEVAPLVERLISDKTFNLETAQRYLENLRS

SEQ ID NO: 3691 - protein, 279 aa, Streptococcus pneumoniae
  misc_feature (B) LOCATION 1...279
  hypothetical: YES
KIMKKKSSIYLDILSHVLLVGATIVAIFPLVWIIISSVKGKGELTQYPTRFWPEQFTLDYFTHVINDLHFIDNIRNSLIIALATTLIAIIISAMAAYGIVRFFPKLGAIMSRLLVITYIFPPILLAIPYSIAIAKVGLTNSLFGLMMVYLSFSVPYAVWLLVGFFQTVPIGIEEAARIDGANKFVTFYKVVLPIVAPGIVATAIYTFINAWNEFLYALILINNTGKMTVAVALRSLNGSEILDWGDMMAASVIVVLPSIIFFSIIQNKIASGLSEGSVK

SEQ ID NO: 3692 - protein, 82 aa, Streptococcus pneumoniae
  misc_feature (B) LOCATION 1...82
  hypothetical: YES
EIMKRILIAPVRFYQRFISPVFPPSCRFELTCSNYMIQAIEKHGFKGVLMGLARILRCHPWSKTGKDPVPDHFSLKRNQEGE

SEQ ID NO: 3693 - protein, 87 aa, Streptococcus pneumoniae
  misc_feature (B) LOCATION 1...87
  hypothetical: YES
YSMKIKEQTRKLAAGCSKQCFEVVDETDEVSSKQCFEVVDETDEVSNHTYGKAKLTWFEEIFEEYKMMGKAGQLVFFDVYRLVRQVS

SEQ ID NO: 3694 - protein, 81 aa, Streptococcus pneumoniae
  misc_feature (B) LOCATION 1...81
  hypothetical: YES
YSMKIKEQTRKLAAGCSKHRFEVADRTDEVSSKHCFEVVDRTDEVSSKHRFEVVDRTDEVSNHTYGKVKLTWFEESFEEYK

SEQ ID NO: 3695 - protein, 60 aa, Streptococcus pneumoniae
  misc_feature (B) LOCATION 1...60
  hypothetical: YES
YSMKIQEQTRKLAASCSKHCFEVVDKTDKVSHIYTVRRRWRGLKRFLKSIKILKILSSIL

SEQ ID NO: 3696 - protein, 112 aa, Streptococcus pneumoniae
  misc_feature (B) LOCATION 1...112
  hypothetical: YES
YSMKIKEQTRKLAAGCSKHSFEVVDETDEVSSKHGFEVVDETDEVSSKHGSEVVDETDEVSSKHGFEVVDETDEVSSKHGFEIVDETDEVSNHTYGKATLTWFEEIFEEYKN

SEQ ID NO: 3697 - protein, 122 aa, Streptococcus pneumoniae
  misc_feature (B) LOCATION 1...122
  hypothetical: YES
YSMKIKVQTRKLAAGCSKHCFKVVDGTDEVSSKHCFEVVDRTDEVSNHIYGKVKLTWFEEIFEEYKSLHNKTHITKVLMNCTPKVRQKKSNFWGSVHSTPDTMRFFNFKDFLQLLLTHIKLF

SEQ ID NO: 3698 - protein, 70 aa, Streptococcus pneumoniae
  misc_feature (B) LOCATION 1...70
  hypothetical: YES
YSMKIKEQTRKLAAGCSKHCFEVADRTDEVSSKHCFEVADRTDEVSNHTYDKATLTRFEEIFEEYKGVPR

SEQ ID NO: 3699 - protein, 151 aa, Streptococcus pneumoniae
  misc_feature (B) LOCATION 1...151
  hypothetical: YES
LQMKLTDYVKQVSLEDFGRPFIHHVQWNRRLRSTGGRFFPKDGHLDFNPKVYQELGLDVFRKIVRHELCHYHLYFQGKGYQHKDRDFKELLKAVDGLRFVPSLPNSNSKPLKLYRCQSCQQTYQRKRRIDTKRYRCGLCRGKLLLINQPED

SEQ ID NO: 3700 - protein, 661 aa, Streptococcus pneumoniae
  misc_feature (B) LOCATION 1...661
  hypothetical: YES
EGMNVLNIKEKDILQFLIKNKERFVTSKELAEYLSCSDRTVRNVLKLIEKTMIIQGVRLISKQGQGYQIFFENQGAYQEFRQTYELEEDYTKTAVSKGDDRLVFILNKLLFEQVPVLFDDLADELYVSRSTLSHDFRKIRVMLSEYNLSIESRANKGVYVSGEERDKRRFIINYFLENQFFKTIHCYVKFNFFDQTVPLEEFARIVLDECQEANLKLSDFVLQNLVVHIALSVIRLKSGFEIKNIDCQMTDDATERKVAQRILSKVREVTNQEFPVQEIDYITLHLLAKSQQCQKNQKNISEEVLKKSLFKTFQNLGLDDMYNFSSDFQLIEGLITHLMTLQVRLESRITLNNPLVDEIKQNYSDIFFMTREILANMDKFLEWTISDDEVAYVSLHFLAAMERSKESTKFNILAICATGFGAAQMLRNRLETEFGKRVEVVDVIGYYELNQEKLKGIDFIVSAVDLSNLYFQIPVFKVSVFLKSDEMEMIRKAMDQMQVSSYVPSSKINKFENNGFRQYFSKENFLICTESDKVNLLEKMVEGLSVGESNEFEQSLLYGIKQREELSSVVFSEKIAVPHPIQPFGTEGKVSVAICKDSLLWDNQSSYVQLVFLLSPSIYGNEGLATVTKKIVSLTENDELQNQLISCNNFEDFINIFEKIK

SEQ ID NO: 3701 - protein, 235 aa, Streptococcus pneumoniae
  misc_feature (B) LOCATION 1...235
  hypothetical: YES
RLMKQLISLKNIFRSYRNGDQELQVLKNINLEVNEGEFVAIMGPSGSGKSTLMNTIGMLDTPTSGEYYLEGQEVAGLGEKQLAKVRNQQIGFVFQQFFLLSKLNALQNVELPLIYAGVSSSKRRKLAEEYLDKVELTERSHHLPSELSGGQKQRVAIARALVNNPSIILADEPTGALDTKTGNQIMQLLVDLNKEGKTIIMVTHEPEIAAYAKRQIVIRDGVISSDSAQLGKEEN

SEQ ID NO: 3702 - protein, 370 aa, Streptococcus pneumoniae
  misc_feature (B) LOCATION 1...370
  hypothetical: YES
VPMNIILIAKLLRENTNTKANALNNGWARSGSEEFKKFSHFVGVDKGIVRTNVLTGKKLSDKIRKEVGSGDSKLGKGGYFSTGDVLLGKDVVSYTVQVFSENNERVGVNTQSHRVQYNLPILADFSVIQDTVEPSRTVVEKIIPKLNIPEEEKGKITEEIKKKKKTSELAELISENVKVRYVDEQGRLLSLKNDTGIGEKESDGTYITNKKQLIGTSYNVTDKKLSSMTTTDGKYYTFKEADTNSASLTGNIVSEGRTVTLVYRESEAPTTATVTANYYKEGSQEKLAESVIKADLAIGSEYTTESKTIEGKTTTEDKEDRVITRKTTYTLVATPANAYQKTVQQLTITTVRMLRKQWFPKQQPLLRRRL

SEQ ID NO: 3703 - protein, 382 aa, Streptococcus pneumoniae
  misc_feature (B) LOCATION 1...382
  hypothetical: YES
QQMKIDKYSAILGNYHVGFHNMSTLTDHRPVASLPFGGKYRLIDFPLSSLANAGVRSVFGIFQQDNISSVFDHIRSGREWGLSTLLSHYYLGIYNTRVESSTVGKEYYQQLLTYLKRSGSNQTVALNCDVLINIDLNQVFHLHSTTKEPITVVYKKLAKKDISEVNAILDVDETDHVLSHKLFDSKSTAETFNMSTDIFVVDTPWLIEHLEEEAKKEHPEKLRYVLRDLAVKEGAFAYEYTGYLANIHSVKSYYQANIDMLESQKFYSLFSPNQKIYTKVKNEEPTYYANTSKVSTSQFASGSIIEGQVANSVLSRNIHVHKDSLVKDSLLFPRVVIGEGAQVEYAILDKGVEVEPGVVIRGTAEHPVVVKKGAKVTEDIHS

SEQ ID NO: 3704 - protein, 236 aa, Streptococcus pneumoniae
  misc_feature (B) LOCATION 1...236
  hypothetical: YES
CKMNQVINAMRKRVCDANQSLPKHGLVKFTWGNVSEVNRELGVIVIKPSGVDYDELTPENMVVTDLDGKILEGDLRPSSDLPTHVQLYKAWSEIGSVVHTHSTEAVGWAQAGRDIPFYGTTHADYFYGSIPCARSLTKDEVEVAYEKDTGLVIVEEFEHRGLNPVEVPGIVVRNHGPFTWGKNPEDAVYHSVVLEEVSKMNRFTEQINSRVEPAPQYILEKHYQRKHGPNAYYGQK

SEQ ID NO: 3705 - protein, 721 aa, Streptococcus pneumoniae
  misc_feature (B) LOCATION 1...721
  hypothetical: YES
NKMNKPTILRLIKYLSISFLSLVIAAIVLGGGVFFYYVSKAPSLSESKLVATTSSKIYDNKNQLIADLGSERRVNAQANDIPTDLVKAIVSIEDHRFFDHRGIDTIRILGAFLRNLQSNSLQGGSTLTQQLIKLTYFSTSTSDQTISRKAQEAWLAIQLEQKATKQEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEEETGYNLLTTGMDVYTNVDQEAQKHLWDIYNTDEYVAYPDDELQVASTIVDVSNGKVIAQLGARHQSSNVSFGINQAVETNRDWGSTMKPITDYAPALEYGIYDSTATIVHDEPYNYPGTNTPVYNWDRGYFGNITLQYALQQSRNVPAVETLNKVGLNRAKTFLNGLGIDYPSIHYSNAISSNTTESDKKYGASSEKMAAAYAAFANGGTYYKPMYIHKVVFSDGSEKEFSNVGTRAMKETTAYMMTDMMKTVLTYGTGRNAYLAWLPQAGKTGTSNYTDEEIENHIKTSQFVAPDELFAGYTRKYSMAVWTGYSNRLTPLVGNGLTVAAKVYRSMMTYLSEGSNPEDWNIPEGLYRNGEFVFKNGARSTWNSPAPQQPPSTESSSSSSDSSTSQSSSTTPSTNNSTTTNPNNNTQQSNTTPDQQNQNPQPAQP

SEQ ID NO: 3706 - protein, 315 aa, Streptococcus pneumoniae
  misc_feature (B) LOCATION 1...315
  hypothetical: YES
KKMKQTKRIKRWRYYLRRFAYQIKILRVLQSISREKYDEKISASLVYGFLSAVAVNFFFQPGHVYSSGATGLAQIISALSNHWFGFHIPISLTFYAINFPLMVLAWYQIGHKFTVFTFITVSMSSFFIQFVPVATLTEDPIINALFGGVVMGLGIGFALRNNISSGGTDIVSLTIRKKTGKNVGSISFLVNGTIMLIAGLTFGWKYALYSMITIFVSSRVTDAVFTKQKRMQAMIVTNHPEKVIEKIHKKLHRGATMIHDAEGTYNHERKAVLITVITRAEFNEFKQIMTQVDPSSFVSVSENVHILGRFVEIDN

SEQ ID NO: 3707 - protein, 310 aa, Streptococcus pneumoniae
  misc_feature (B) LOCATION 1...310
  hypothetical: YES
KTVKSIKRFALSAMGVAMLLVLTGCVNVDKTTGQPTGFIWNTIGAPMAEAIKYFATDKGLGFGVAIIIVTIIVRLIILPLGIYQSWKATLHSEKMNALKHVLEPHQTRLKEATTQEEKLEAQQALFAAQKEHGISMFGGVGCFPILLQMPFFSAIYFAAQHTEGVAQASYLGIPLGSPSMILVACAGVLYYLQSLLSLHGVKDEMQREQIKKMIYMSPLMIVVFSLFSPASVTLYWVVGGFMMILQQFIVNYIVRPKLRKKVREELAKNPPKASAFSKPSGRKDVTPEQPTAITSKKKHKNRNAGKQRSR

SEQ ID NO: 3708 - protein, 306 aa, Streptococcus pneumoniae
  misc_feature (B) LOCATION 1...306
  hypothetical: YES
IMVKEFKEGSMKNSIMDTKFDRRILLLNKIIIVFIVLMTLLPLLYIVVASFMDPKVLVSRGISFNPADWTVEGYQRVFSDQSILRGFINSLLYSFGFAALTVLLSVFTAYPLSKKDLVGRRWINYFLIVTMFFGGGLVPTYLLVKELGMLNTPWAIIVPGAVNVWNIILARAYFQGLPEELVEAAVIDGANDLQIFFKIMLPLAKPIMFVLFLYAFVGQWNSYFDAMIYIKDPNLEPLQLVLRKILIQSQPGQDMIGAQAAMNEMKRLAELIKYATIVISSLPLIVMYPFFQKYFDKGIMAGSLKG

SEQ ID NO: 3709 - protein, 212 aa, Streptococcus pneumoniae
  misc_feature (B) LOCATION 1...212
  hypothetical: YES
LVVKIIQKGIFIMSQAISLNQSTWASKLKAMGPGILMATAAVGGSHIVSSTQAGGSYGWSLLLLVILANVFKYPFFRFGAEYTADTGKTLVEGYAEKGKLYLWIFFILNVFSAMVNTAGVAILCSAIIASAFPMIGLSITQWSLILVAIIWAMLLFGGYKLLDGMVKWIMSALTIATVLAVIIAAVKHPEYSSDFVEKTPWQMAALPSSSPS

SEQ ID NO: 3710 - protein, 81 aa, Streptococcus pneumoniae
  misc_feature (B) LOCATION 1...81
  hypothetical: YES
YSSKISSNHVSVALPYVWLLTSSVSSTTSKQCFELTSSVSSTTSKTCFELTSSVLSTTSKQCFEQPAASFLVCSLIFIEYK

SEQ ID NO: 3711 - protein, 66 aa, Streptococcus pneumoniae
  misc_feature (B) LOCATION 1...66
  hypothetical: YES
YSSKISSNHVSVTLPYIWLLTSSVLSTTSKQCFEQPAASFLVCSLISIEYEKKYSGYSLTLTTPPD

SEQ ID NO: 3712 - protein, 486 aa, Streptococcus pneumoniae
  misc_feature (B) LOCATION 1...486
  hypothetical: YES
LLSKIGLTTTLKNAWTTSRQVNFFWVANFNLKFGIPTLYTLSSGRVLSSIDARYGGTHDSKSKINIATSYSDDNGKTWSEPIFAMKFNDYEEQLVYWPRDNKLKNSQISGSASFIDSSIVEDKKSGKTILLADVMPAGIGNNNANKADSGFKEINGHYYLKLKKNGDNDFRYTVREKGVVYDETTNKPTNYTINDKYEVLEGGKSLTVEQYSVDFDSGSLRERHNGKQVPMNVFYKDSLFKVTPTNYIAMTTSQNRGESWEQFKLLPPFLGEKHNGTYLCPGQGLALKSSNRLIFATYTSGELTYLISDDSGQTWKKSSASIPFENATAEAQMVELRDGVIRTFFRTTTGKIAYMTSRDSGETWSKVSYIDGIQQTSYGTQVSAIKYSQLIDGKEAVILSTPNSRSGRKGGQLVVGLVNKEDDSIDWRYHYDIDLPSYGYAYSAITELPNHHIGVLFEKYDSWSRNELHLSNVVQYIDLEINDLTK

SEQ ID NO: 3713 - protein, 356 aa, Streptococcus pneumoniae
  misc_feature (B) LOCATION 1...356
  hypothetical: YES
IKSKNLKKGETMLAIEESQKLTLSNLPSLSLFTGTDQGQFEVMKSQVLKQIGYDSADLNFAYFDMKEVVYKDVELELVSLPFFADEKIVILDYFMDITTAKKRFLTDDELKSFEEYLDNSSPTTKLIIFAEGKLDSKRRLVKLLKRDAKVFDAVEVKEQELRQYFQKWSQKQGLQFTNHSFENLLIKSGFQFSEIQKNLLFLQSYKANSVIEEEDIVNAIPKTLQDNIFDLTQFILTKKMDQARDLVRDLTLQGEDEIKLIAVMLGQFRTFTQVKILAESGQTESQIASSLGSYLGRNPNPYQIKFALRDSRGLSLSFLKQAISYLIETDYQIKTGLYEKGFLFEKALLQIASQVN

SEQ ID NO: 3714 - protein, 117 aa, Streptococcus pneumoniae
  misc_feature (B) LOCATION 1...117
  hypothetical: YES
QFPKGSNHSFLFQLVMSLITHKRFISCNENIKHYKRLIDKAETCVNDLMAEFNSIITTVTGIGNRLGAVILAEIRNIHAFDNPAQLQAFAGLDSSIYQSGQIDLAGRMVKRGSPHLR

SEQ ID NO: 3715 - protein, 151 aa, Streptococcus pneumoniae
  misc_feature (B) LOCATION 1...151
  hypothetical: YES
MYTKSRTIKSLITQFTAILLYELPVALDSLVFMGFSMKLIHDLNTHTTHSTAKMLYNVKAKLFSQAIVRAKHIHSNNFDATSDNSIVAKKVISNDSLCSTLKNSDDIEIVKILRNEAHLSLCKSILIPRHNLRKTRKIMFKVKIIELTNNS

SEQ ID NO: 3716 - protein, 189 aa, Streptococcus pneumoniae
  misc_feature (B) LOCATION 1...189
  hypothetical: YES
LITKERRSIMANRLKEKYLNEVVPALTEQFNYSSVMAVPKVDKIVLNMGVGEAVSNAKSLEKAAEELALISGQKPLITKAKKSIAGFRLREGVAIGAKVTLRGERMYEFLDKLVSVSLPRVRDFHGVPTKSFDGRGNYTLGVKEQLIFPEINFDDVDKTRGLDIVIVTTANTDEESRALLTGLGMPFAK

SEQ ID NO: 3717 - protein, 202 aa, Streptococcus pneumoniae
  misc_feature (B) LOCATION 1...202
  hypothetical: YES
ERTNTMYAYLKGIITKITAKYIVLETNGIGYILHVANPYAYSGQVNQEAQIYVHQVVREDAHLLYGFRSEDEKKLFLSLISVSGIGPVSALAIIAADDNAGLVQAIETKNITYLTKFPKIGKKTAQQMVLDLEGKVVVAGDDLPAKVAVQASAENQELEEAMEAMLALGYKATELKKIKKFFEGTTDTAENYIKSALKMLVK

SEQ ID NO: 3718 - protein, 334 aa, Streptococcus pneumoniae
  misc_feature (B) LOCATION 1...334
  hypothetical: YES
WMTKILLFGEPLIRISPLDATSIGDHVASSTYFGGSEINIACNLQALGISTKVFTALPANEIGDRFLTFLKQHQIDTSSICRLGDRIGLYYLENGFGCRQSEVFYDRKHTSISQIRPNMLDMDSLFQGISHFHFSGITVAIGQEVRAILLLLLEEAKRRGIVVSMDLNLRTKMISVLEAKYEFSKFARFTDYCFGIDPLMIDDQNLEMFPRDSASLEEVENRMRLLKEAYGFKAIFHTLRSSDEQDKNVYQAYALEERFEESVQLKTAVYQRIGSGDAFISGALYQLLHHSSLKTTIDFAVASATLKCTLPGDHLSTSATSIENLLANAQDIIR

SEQ ID NO: 3719 - protein, 324 aa, Streptococcus pneumoniae
  misc_feature (B) LOCATION 1...324
  hypothetical: YES
LFANSIGEEVSMVQEIAQEIIRSARKKGTQDIYFVPKLDAYELHMRVGDERCKIGSYDFEKFAAVISHFKFVAGMNVGEKRRSQLGSCDYAYDHKIASLRLSTVGDYRGHESLVIRLLHDEEQDLHFWFQDIEELGKQYRQRGLYLFAGPVGSGKTTLMHELSKSLFKGQQVMSIEDPVEIKQDDMLQLQLNEAIGLTYENLIKLSLRHRPDLLIIGEIRDSETARAVVRASLTGATVFSTIHAKSIRGVYERLLELGVSEEELAVVLQGVCYQRLIGGGGIVDFASRDYQEHQAAKWNEQIDQLLKDGHITSLQAETEKISYS

SEQ ID NO: 3720 - protein, 446 aa, Streptococcus pneumoniae
  misc_feature (B) LOCATION 1...446
  hypothetical: YES
IGAKMKRTGLFAKIFIYTFSIFSVLVICLHLAIYFLFPSTYLSHRQETIGQKATAIAQSLEGKDRQSIEQVLDLYSQTSDIKGTVKGEMTEDKLEVKDSLPLDTDRQTTSLFIEEREVKTQDGGTMILQFLASMDLQKEAEQISLQFLPYTLLASFLISLLVAYIYARTIVAPILEIKRVTRRMMDLDSQVRLRVDSKDEIGNLKEQINSLYQHLLTVIADLHEKNEAILQLEKMKVEFLRGASHELKTPLASLKILIENMRENIGRYKDRDQYLGVALGIVDELNHHVLQILSLSSVQELRDDRETIDLLQMTQNLVKDYALLAKERELQIDNSLTHQQAYLNPSVMKLILSNLISNAIKHSVPGGLVRIGEREGELFIENSCSSEEQEKLAQSFSDNASRKVKGSGMGLFVVKSLLEHEKLAYRFEMEENRLTFFIDFPKVAQD

SEQ ID NO: 3721 - protein, 520 aa, Streptococcus pneumoniae
  misc_feature (B) LOCATION 1...520
  hypothetical: YES
RSANTRKARTAKPTRPSRRSRRSASGCARVPTKPAITHRPARSCGASAHEPGAAVARPTPAPGPGRARPGPPIATGSRRGAGTHRAPGGATGLPRLATGRRATAVSRLPGGHARPPAPGSLAAAGRTAAGKGSRPGTGLRRDRAAPRRGARAPAAVPARTAGTPAATGEVRRTGAPRRRRAPGAARTQRGRRTGRIHPPRDLAMLKLNAVDTAPLVSSDTPAPLPPLRAQQIAFEQALPAHRPPAPRPPFDKGDETTEAEEPAANSDAPTSTPLADQPAAPAADRPPTNRQAPVPVAAEATPTPTPTPTPTPTPTPTPTVLPSGSVARQAPAVSARVAASTQAREPASVSAPPVDEPPLVPVSSHPQIAGRTHERPQPGPGFPAKTAAEVASTAQASVQVSPPAPTAGGEGRGEERRQPGETDPSALPPDDQAPVPLPAMQTPGDRLLARLLASSGSRPLPLADLARLLDAVQGRIQVASAAESHAARLQVRLPQLGAVEVQVLHGHGQLQVVFTTSREV

SEQ ID NO: 3722 - protein, 461 aa, Streptococcus pneumoniae
  misc_feature (B) LOCATION 1...461
  hypothetical: YES
INQNRKRSMYKTKCLREKLVLFLKIFFPILIYQFANYSASFVDTAMTGQYNTMDLAGVSMATSIWNPFFTFLTGIVSALVPIIGHHLGRGKKEEVASDFYQFIYLALGLSVVLLGMVLFLAPTILNHIGLEAAVAAVAVRYLWFLSIGIIPLLLFSVIRSLLDSLGLTKLSMYLMLLLLPLNSGFNYLLIYGAFGVPELGGAGAGLGTSLAYWVLLGISVLVLFKQEKLKALHLEKRIPLNMDKIKEGVRLGLPIGGTVFAEVAVFSVVGLIMAKFSSLIIASHQSAMNFSSLMYAFPMSISSAMAIVVSYEVGAKRFDDAKTYIGLGRWTALIFAAFTLTFLYIFRGNVASLYGNDPKFIDLTARFLTYSLFFQLADTFAAPLQGILRGYKDTVIPFYLGLLGYWGVAIPVATLFDSLTDFGAYSYWIGLIISLIVSGALYRWRLTVIMKRFESLAKSKR

SEQ ID NO: 3723 - protein, 342 aa, Streptococcus pneumoniae
  misc_feature (B) LOCATION 1...342
  hypothetical: YES
KYQKTRRSANASVKMVLFSAQEQLYYKEKIMTTNRLQVSLPGLDLKNPIIPASGCFGFGQKYAKYYDLDLLGSIMIKATTLEPRFGNPTPRVAETPAGMLNAIGLQNPGLEVVLAEKLPWLEREYPNLPIIANVAGFSKQEYAAVSHGISKATNVKAIELNISCPNVDHCNHGLLIGQDPDLAYDVVKAAVEASEVPVYVKLTPSVTDIVTVAKAAEDAGASGLTMINTLVGMRFDLKTRKPILANGTGGMSGPAVFPVALKLIRQVAQTTDLPIIGMGGVDSTEAALEMYLAGASAIGVGTANFTNPYACPDIIENLPKVMDKYGISSLEELRQEVKESLR

SEQ ID NO: 3724 - protein, 72 aa, Streptococcus pneumoniae
  misc_feature (B) LOCATION 1...72
  hypothetical: YES
FNQKSVDTASRNPLIGLDNAIWHNSSTLNIPTNIDLTSIPPYTPEMNPLNKCGKRFVNVDLRIKPFELWKIS

SEQ ID NO: 3725 - protein, 434 aa, Streptococcus pneumoniae
  misc_feature (B) LOCATION 1...434
  hypothetical: YES
WLQKSRKKNVMNEIKCSNCGGVXTVNESQYSELLSQVRTAEFDKELHDRMRQELALAEQKAMNEQQTKLAQKDQEIAQLQSQIQNFDTEKELAKKEVEQTSHQALLAKDKEVQALENQLATLRLEHENQLQKTLSDLEKERNQVKNQLLLQEKENELSLASVKQNYEAQLKAASEQVEFYKNFKAQQSTKAIGESLEQYAESEFNKVRSFAFPNAYFEKDNKVSSRGSKGDFIFRECDENGVEIISIMFEMKNEADGTEKKHKNADFYKELDKDRREKNCEYAVLVTMLEADNDYFNTGIVDVSHEYEKMYVVRPQFFIQLIGLLRNAALNSLKYKQELALVREQNIDITHFEEDLDAFKLAFAKNYNSASTNFGKAIDEIDKAIKRMEEVKKFLTTSENQLRLANNKLEDVSVKKLTRKNPTMKAKFEALKGE

SEQ ID NO: 3726 - protein, 219 aa, Streptococcus pneumoniae
  misc_feature (B) LOCATION 1...219
  hypothetical: YES
KNKKIVAINNGINVSNSDLDVVGVQDFKKEFCIPNNKKIICYVGRLDPEKRPDRFLEFAEKLFLVREDVIFIMAGNGSMWAALKEKICHLKCRDNFRLLGEIYPATIVYQISDLLYIPYDTEGIPMCVLESMSQGTPVLASNVGGLSEIIEHRVDGFLFEKEDVEGVCACANFLLNDSEYLKYIGENSKSKIRKHFSVQKMFVETMRVYDELLEKSSHG

SEQ ID NO: 3727 - protein, 102 aa, Streptococcus pneumoniae
  misc_feature (B) LOCATION 1...102
  hypothetical: YES
MNKKKMILTSLASVAILGAGFVTSQPTVVRAEESPVASQSKAEKDYDAAVKNATAAKKAAEDAQRALDEAKAAQKKYDEDQKKTEEKAKEVKKASEENKLQI

SEQ ID NO: 3728 - protein, 2123 aa, Streptococcus pneumoniae
  misc_feature (B) LOCATION 1...2123
  hypothetical: YES
RGKKMDALTRRQFDRAMFAKERTLAIRVGEYASRDIKEASFEYGYIKGDTYKPGGTCAGSGKITFTSIITTFNKLDTLHPEIGLLVGDTYQWVKMGEYFINDIEIDRNRNTTTLELMDGMFKLNREYVTDLHFPAEVREVIQEICLKTGIELANDYFGISAMRYHIEQVPEGKKLSFRDMLSAMTQMIGMSCFFNREGKMEIRDLTESNITINADSYFLHGLTKSEIEYQIAGITCKTDKKSLTVGMTTGRSLELDNVFITQSALNDLYYKLKNLTYYPYNLNYQGHLLLEVGQWVTIQTNKKETFKVPVLSQSFIFKGGLRGRISADSKAGNDTQYSYEGTITKQIKQQDGFEAKIQAQIEAADKDFDQKVDKIKKDFNDQVELAKARAEEVKRELSDTINQRFNSFDNGPLKEAKRKAEEALRNAGASSSLAQESKRIGLDSVARLEAFKSQTTSAQTALSGDLDVLKRTIANDIRPKQAQAEAEIAKQVEALSRTKNELDGASTLLAQEAKRIELDSVARLEAFKSQTTSAQTALSGDLDVLKRTIANDIRPKQAQAEAEIAKQVEALSRTKNELAGVKSAQATYEETTTRRLSELTNLANGKASKSELTQTAEELASRIASVQAGSSRNYFRNSRSRTFTTGGQAVYDYRTFIVPDFWKNSDRFKRDYVRISFDVTFPVALVNDMPAMVHFSAHPWYAYRNLIFKGGTVERQHFEFTIDLSSSSETYQTNNVFIRFGTNYGFPAGLQVVIENAMLSVGNYFPAYQPAYEDQDERVSAVESNFKQRADSLDAGVSRLTEGLRTKVDISSLNVTAENIRQSVKSLETDTQNKLNQKLSQAEFEVRAGSIRQEILNATKDKASKSELTQTAEELASKIASVHLGRRNLLKGTKELARYKPVSEYNGFKVIRTVAGATRYQDSYVERTVIPTAGTEYIAIFYARASENDYPVRCHFYNPNTVVSSENSSGYKSRSSDGLSIIRLSTDWQLCWVKWTQTATDQAKTVIIGRHGPQVGGKEGVWVEICAPAIFEGNLAGDWSPAYEDQDERVSVVESNFKQRADSLDAGVSRLTEGLRTKADISSLNVTAENIRQSVKSLETDTQNKLNQKLSQAEFEVRAGSIRQEILNATKDKADKTLVVTEAGKLREEFSKMKVGGRNLWIKSKTVGAVIEKLPENHVTGQKECYRLENNSTLTFNLEPDFSSRLYQKVTFSAWIKYENVVQGRNFWNVFNCFKHYLFRKNSETGVQSGPDYATLGMYKGSADWKYITFTYDYSEKTNFDQLKTSLRFNLEGATSGTAWVTGIKVEIGSVATDWNPAPEDADGLITEAKATFERTAQGLRTDLSAIQEYVNKDGQRQEALQRYTREESARQATAVRELVNRDFVGKATYQEDVKGINQRIEAVKTSANKDIASQIASYRQSVDGKFTDISSQITTYKQDVGGQISGLSNRLTSSEQGTTTQISNLSNRINSNKQGTDNQISNLKTQVATNKDNAERQMGRISDQVSANKANADSQFANVTNQLARKVETTDFQRVKETSKLYERILGNTENGIADKVARMALTNQLFQVEVGKYSVSGPNLIKNSDFKNATNEWGSTQNLGRLVKHSFYHNGQKDLMRLSNATKNENFLYSHRFNLERNTDYVLNFRGFNNSALASYDVYILGRRAGESDGFTIVKKVVSSKKLSTSRCEDVSVTFNSGEMDNAYIRFDNNGSSSGTADLYITEVDLYKGYKPRTWQPHPEDAVADANKKLEATQTKMTQLAGSWVVENINSAGDIISGINLGANGHNRLVGKLTHITGETLIDRAVIKSAMVDKLKTANFEAGSVTTTILEAEAVTAEKLKVDNALIKKLTATDAFIDQLISKRIFSTKVESVISSSTFLEAYQGRIGGFTLGQFDQGGGRWISGVNQFSVGMGNGAGYGVRTAFWANWGNNWNYAGPKAWNVNTDGKMYCRNEVGFYDQVDFSNSSRANFYGNTTFSRSPVFSNGIELGSKDVLGDGWNPKGGRNAVVWWNQVGSGSLKYWMEQKSDRRLKENITDTAVKALDKINRLRMVAFDFIENKKHEEIGLIAQEAETIVPKIVSRDPENPDGYLHIDYTALVPYLIKAIQELNQKIEKMEKTIA

SEQ ID NO: 3729 - protein, 326 aa, Streptococcus pneumoniae
  misc_feature (B) LOCATION 1...326
  hypothetical: YES
KGKKMSTLDKNLLLEMFRKMEEIRRMDLKIAQLVKKGKVPGMTHFSVGEEAANVGAMLALNPDDLITSNHRGHGQAIAKGIDLNGMMAEILGKYTGTCKGKGGSMHIADLDAGNLGANGIVGGGMGIAVGAALSQQMQNTGKIVVCFFGDGATNEGVFHEAVNMASIWNLPVIFYCINNGYGISADIKKMTNIEHIHQRSAAYGIPGMFIEDGNNVIDVYEGFQKAVDHVRSGNGPVLIESVTYRWLGHSSSDPGKYRTREEVELWKQKDPIENLRNYLIENNIASAEELEEIQAQVKEAVEASVKFAEESPFPSLESAFEDIYAD

SEQ ID NO: 3730 - protein, 316 aa, Streptococcus pneumoniae
  misc_feature (B) LOCATION 1...316
  hypothetical: YES
MGKKRWARNGSESNDASYAQVVSLYDDTSISVSNNETDKVLTGSLYTETNEQGLTIPSSLLKNWNEQTGKNLTTNDLIGKSVSASIVESAAETSKIAQFQTKIVRVINDEDDMEDSNSFMLSHQMETILKEAGFTKAVSYFILELKDPSQTKVVTEELQKNKKYTVLSQQRVLDIVITFIRVIQGLLIVLSSQAIVVAAVMIGIIIYINIMQRSKEIGVMKAVGYQNRGVKGIFIYEAIWIVGIALLLAFLVAQGVGSLANAIVSHFYPSITKVFELNLLSVLGTLVFALLLGYVSAYFPARKISKMDPVESLRYE

SEQ ID NO: 3731 - protein, 128 aa, Streptococcus pneumoniae
  misc_feature (B) LOCATION 1...128
  hypothetical: YES
PLKKTTGTCHLQISHLSGVMAVSSRPRFLQKITDAYNRDADLAHLLLDEYFLDVTAKYQQAVRDIVALAVQAGVPVPTFSAAITYFDSYRSADLPANLIQAQRDYFGAHTYQRKDKEGTFHYSWYDEK

SEQ ID NO: 3732 - protein, 504 aa, Streptococcus pneumoniae
  misc_feature (B) LOCATION 1...504
  hypothetical: YES
KLKKREDMITGELKNKIDQLWEILWTEGNANPLTNIEQLTYLLFMKDLDSVELGRESDAEFLGIPYEGVFPKDKPEYRWSTFKNIGDAQEVYRLMTQEIFPFIKNLKGDTDDTAFSRYMREAIFQINKPATLQKAISILDVFPTRGLDVDFDNDKQSITDIGDIYEYLLSKLSTAGKNGQFRTPRHIIDMMVELMQPTIKDIISDPAMGSAGFLVSASRYLKRKKDEWETNTDNINHFHNQMFHGNDTDTTMLRLGAMNMMLHGVENPQISYLDSLSQDNEEADKYTLVLANPPFKGSLDYNSTSNDLLATVKTKKTELLFLSLFLRTLKPGGRAAVIVPDGVLFGSSKAHKGIRQEIVENHKLDAVISMPSGVFKPYAGVSTAILIFTKTGNGGTDKVWFYDMKADGLSLDDKRQPIRDNDIPDIIERFHHLEKEAERQRTDQSFFVPVAEIKENDYDLSINKYKEIEYEKVEYEPTEVILKKINDLEKEIQAGLAELEKLLK

SEQ ID NO: 3733 - protein, 714 aa, Streptococcus pneumoniae
  misc_feature (B) LOCATION 1...714
  hypothetical: YES
LLKKTVEKAVADNVKDSIDVPAAYLEKAKGEGPFTAGVNHVIPYELFAGDGMLTRLLLKASDKAPWSDNGDAKNPALSPLGENVKTKGQYFYQVALDGNVAGKEKQALIDQFRANGTQTYSATVNVYGNKDGKPDLDNIVATKKVTININGLISKETVQKAVADNVKDSIDVPAAYLEKAKGEGPFTAGVNHVIPYELFAGDGMLTRLLLKASDKAPWSDNGDAKNPALSPLGENVKTKGQYFYQVALDGNVAGKEKQALIDQFRANGTQTYSATVNVYGNKDGKPDLDNIVATKKVTININGLISKETVQKAVADNVKDSIDVPAAYLEKAKGEGPFTAGVNHVIPYELFAGDGMLTRLLLKASDKAPWSDNGDAKNPALSPLGENVKTKGQYFYQVALDGNVAGKEKQALIDQFRANGTQTYSATVNVYGNKDGKPDLDNIVATKKVTININGLISKETVQKAVADNVKDSIDVPAAYLEKAKGEGPFTAGVNHVIPYELFAGDGMLTRLLLKASDKAPWSDNGDAKNPALSPLGENVKTKGQYFYQLALDGNVAGKEKQALIDQFRANGTQTYSATVNVYGNKDGKPDLDNIVATKKVTIKINVKETSDTANGSLSPSNSGSGVTPMNHNHATGTTDSMPADTMTSSTNTMAGENMAASANKMSDTMMSEDKAMLPNTGETQTSMASIGFLGLALAGLLGGLGLKNKKEEN

SEQ ID NO: 3734 - protein, 130 aa, Streptococcus pneumoniae
  misc_feature (B) LOCATION 1...130
  hypothetical: YES
SSKNTSTSNDEKTVATSNSSKETITFDTPVVTDDAIESIRTYADYIDLYKNIFDDYFTKAEEGFKGTAMENNDSFTKLKESTQKLFDAQKKRLNNEDRIETTKNNVIAKHCQTVLSFLVLTSFFVKNCVK

SEQ ID NO: 3735 - protein, 158 aa, Streptococcus pneumoniae
  misc_feature (B) LOCATION 1...158
  hypothetical: YES
TQKKSFWYNKSMYTKNEEELQALGERLGHLLAKNDVLILTGELGAGKTTFTKGLAKGLQISQMIKSPTYTIVREYEGRLPLYHLDVYRIEGDADSIDLDEFIFGGGVTVIEWGNLLGDALPDAYLELEILKEADGRRLNFQAKGLRAEKLLEELQYGV

SEQ ID NO: 3736 - protein, 573 aa, Streptococcus pneumoniae
  misc_feature (B) LOCATION 1...573
  hypothetical: YES
NKKNCCDINRFGGFFNMVLDKASCDLLQYLMDQETSKTIMAISKDLKESRRKIYYHIDKINAALVDEALHIISIPRIGIHLTEEQRDACCKLLSEVDSYDYIMSAHERMMIMLLWIGISKERITIEKLIELTEVSRNTVLNDLNSIRYQLTLEQYQVTLQVSKSQGYHLHAHPLNKIQYLQSLLYHIFMEENATFVSILEDKMKERLDDECLLSVEMNQFFKEQVPLVEQDLGKKINHHEITFMLQVLPYLLLSCHNVEQYQERHQDIEKEFSLIRKRIEYQVSKKLGERLFQKFEISLSGLEVSLVAVLLLSYRKDLDIHAESDDFRQLKLALEEFIWYFESQIRMEIENKDDLLRNLMIHCKALLFRKTYGIFSKNPLTKQIRSKYGELFLVTRKSAEILEGAWFIRLTDDDIAYLTIHIGGFLKYTPSSQKNMKKVYLVCDEGVAVSRLLLKQCKLYFPNEQIDTVFTTEQFKSVEDIAQVDVVITTNDDLDSRFPILRVNPILEAEDILKMLDYLKHNIFRNKSKSFSENLSSLISSYIVDSKLASKFQEEVQTLINQEIVVQAFLEDI

SEQ ID NO: 3737 - protein, 93 aa, Streptococcus pneumoniae
  misc_feature (B) LOCATION 1...93
  hypothetical: YES
SKKNFSDSLRYYPYRSLKERNRKMEEWKERFKKEYYELKERFQKLDMMIGKYEKGQLEFESKCPIDSLKGQRSTMWNYLRILEQRAKIEEIKL

SEQ ID NO: 3738 - protein, 303 aa, Streptococcus pneumoniae
  misc_feature (B) LOCATION 1...303
  hypothetical: YES
LRKKEERKIMRAKKLDKLATAVLYTIASIIVTILASLILYILVRGLPHISWSFLTGRSSAFQAGGGIGIQLYNSFFLLVITLIISVPLSMGAGIYLAEYAKKGPVTNFVRTCIEILSSLPSVVVGLFGYLIFVVQFEYGFSIISGALALTVFNLPQMTRNVEDSLKHVHHTQREAGLALGISRWETVVHVVIPEALPGIVTGVVLASGRIFGEAAALIYTAGQSAPALDWSNWNILSVTSPISIFRQAETLAVHIWKVNSEGTIPDGTIVSAGSAAVLLIFILIFNFGARKFGSYLHKKLTAA

SEQ ID NO: 3739 - protein, 124 aa, Streptococcus pneumoniae
  misc_feature (B) LOCATION 1...124
  hypothetical: YES
VLKKNFRVKREKDFKAIFKEGTSFANRKFVIYQLENQKNHFRVGLSVSKKLGNAVTRNQIKRRIRHIIQNAKGSLVEDVDFVVIARKGVEALGYAEMEKNLLHVLKLSKIYQEGNGSEKETKVD

SEQ ID NO: 3740 - protein, 249 aa, Streptococcus pneumoniae
  misc_feature (B) LOCATION 1...249
  hypothetical: YES
LLKKRLICQILKFCKRVTMSRIEFSPSLMTMDLDKFKEQITFLNDKVASYHIDIMDGHFVPNITLSPWFIQEVQKISDTPLSVHLMVTDPTFWVDQVLDLQCEYICIHAEVLNGLAFRLIDKIHDAGLKAGVVLNPETPVSTIFPYIDLLDKVTIMTVDPGFAGQRFLESTLYKIQELRQLRVQNGYHYIIEMDGSSSRKTFKQIDVAGPDIYVIGRSGLFGLDDDIAKAWDICSRDYEEMTGKTMPIK

SEQ ID NO: 3741 - protein, 154 aa, Streptococcus pneumoniae
  misc_feature (B) LOCATION 1...154
  hypothetical: YES
TMKKMKYYEETSALLHEFSEENQKYFEELWESFNLAGFLYDEDYLREQIYLMMLDFSEAERDGMSAEDYLGKNPKKIMKEILKGAPRSSIKESLLTPILVLVVLRYYQLLSDFSKGPLLTVNLLTFLGQLLIFLIGFGLVATILRRSLVKILLK

SEQ ID NO: 3742 - protein, 98 aa, Streptococcus pneumoniae
  misc_feature (B) LOCATION 1...98
  hypothetical: YES
EMKKTSSKLFVVPYMLWIALFVLAPLVLIFGQSFFNIEGQFSLENYKSYFASQHLTYLINEFQLSALCRDCDLCDLSYQLSNSPLFDPSQARVNSGSC

SEQ ID NO: 3743 - protein, 468 aa, Streptococcus pneumoniae
  misc_feature (B) LOCATION 1...468
  hypothetical: YES
RMKNQEYWAKRKANLIYQQMDKAEKQADQFDKVYQEAKTYLDKEINKIFDKFQRDYGLSQVEARQVLKNMKDKKNLNELRKVLEARPNDPNIQRLLADLDSPAYSFRMKRLERLSDDLDRMRESIYHSEKTGSDAFYSDLMKDSYYKATFDLQQQTGLAYGFSGLPENEIKHLQSFSWVGDGSTYSTDIWKNTGKLTSSIKDELLISLMTGRDTRETAQAIAERFNVGQNDARRLVRTESAFFHNQMELLSYEEADIEKYIFVAVLDKRTSRICQEHDNQVYDRDKAVPGVNCPPMHPWCRSTTVGYDEDADYSKLKRRARNPETGKVEYVPADMTYKEWYSKYVDGNRESIKRKAFDKTIKDGIIVSVSGTTIGHTPPGKIGLPNSVVQHNATNGDVLGRTYYDARGFKTKDVHFTNHKQPARHPYGKIGEHAHDFVFDDEGKFVSRSTRELTDDERKENQDILWRY

SEQ ID NO: 3744 - protein, 76 aa, Streptococcus pneumoniae
  misc_feature (B) LOCATION 1...76
  hypothetical: YES
NQKKLERIPLSILTFYIPKVPSYSIKEKQSKWLQSGYKSIKTDKAILSSSPIQTILSVVESHHISLRSRTSLKRRK

SEQ ID NO: 3745 - protein, 297 aa, Streptococcus pneumoniae
  misc_feature (B) LOCATION 1...297
  hypothetical: YES
REKKMQNKQEQWTVLKRLMSYLKPYGLLTFLALSFLLATTVIKSVIPLVASHFIDQYLSNLNQLAVTVLLVYYGLYILQTVVQYVGNLLFARVSYSIVRDIRRDAFANMEKLGMSYFDKTPAGSIVSRLTNDTETISDMFSGILSSFISAVFIFLTTLYTMLVLDFRLTALVLLFLPLIFLLVNLYRKKSVKIIEKTRSLLSDINSKLAENIEGIRIIQAFNQEKRLQAEFDEINQEHLAYANRSVALDALFLRPAMSLLKLLGYAVLMTYFGYRGLSIGITAGTMYAFIQYINRPL

SEQ ID NO: 3746 - protein, 82 aa, Streptococcus pneumoniae
  misc_feature (B) LOCATION 1...82
  hypothetical: YES
IFEKTLRPSSTATIIVAKLSSARIISEAPLETSVPVIPIPIPMSAVFRAGASLTPSPVMATTLPCFCQALTIRTLCSGDTRA

SEQ ID NO: 3747 - protein, 404 aa, Streptococcus pneumoniae
  misc_feature (B) LOCATION 1...404
  hypothetical: YES
FGEKGFILKSIGFIEKLKGLSSKELILLGIILSIFLPFYLFVVVLCLYIISLIFTGDMKSILQKMGEHPMLLLFLSYSTVISILAQNWMGLVASVGMFLFTIFFLHYQSILSHKFFRLILQFVLFGSVLSAVFASLEHFQIVKKFNYAFLSPNMQVWHQNRAEVTFFNPNYYGIICCFCIMIAFYLFTTTKLNWLKVFCVIAGFVNLFGLNFTQNRTAFPAIIAGAIIYLFTTIKNWKAFWLSIGVFAIGLSFLFSSDLGVRMGTLDSSMEERISIWDAGMALFKQNPFWGEGPLTYMHSYPRIHAPYHEHAHSLYIDTILSYGIVGTILLVLSSVAPVRLMMDMSQESGKRPIIGLYLSFLTVVAVHGIFDLALFWIQSGFIFLLVMCSIPLEHRMLVSDMTD

SEQ ID NO: 3748 - protein, 231 aa, Streptococcus pneumoniae
  misc_feature (B) LOCATION 1...231
  hypothetical: YES
NLEKIFMEPDIFIITKLLSDPSRMHILDILMDGKAHTVNEIASFTKIKQHTVSYHLKLLTEAQVTTLQTYGRFHYYSLKSAAIAEMLEFLSFYSPQRDVKSYKQHIHKKELKVARTCYDHIAGELGISITNYLLQENLLSESEKDFQLTEAGKSYFQRKLHIDTDELKKKKRKFCPKCLDWSERKNHVGGALGNALLEFFSEKQLVIPAQTPRSLTITEKGKEFLEKEWGI

SEQ ID NO: 3749 - protein, 286 aa, Streptococcus pneumoniae
  misc_feature (B) LOCATION 1...286
  hypothetical: YES
YKEKYMYLIEILKSIFFGIVEGITEWLPISSTGHLILAEEFIQYQNQNEAFMSMFNVVIQLGAILAVMVIYFNKLNPFKPTKDKQEVRKTWRLWLKVLIATLPLLGVFKFDDWFDTHFHNMVSVALMLIIYGVAFIYLEKRNKARAIEPSVTELDKLPYTTAFYIGLFQVLALLPGTSRSGATIVGGLLNGTSRSVVTEFTFYLGIPVMFGASALKIFKFVKAGELLSFGQLFLLLVAMGVAFAVSMVAIRFLTSYVKKHDFTLFGKYRIVLGSVLLLYSFVRLFV

SEQ ID NO: 3750 - protein, 301 aa, Streptococcus pneumoniae
  misc_feature (B) LOCATION 1...301
  hypothetical: YES
YKEKKMTKKQLHLVIVTGMSGAGKTVAIQSFEDLGYFTIDNMPPALLPKFLQLVEIKEDNPKLALVVDMRSRSFFSEIQAVLDELENQDGLDFKILFLDAADKELVARYKETRRSHPLAADGRILDGIKLERELLAPLKNMSQNVVDTTELTPRELRKTLAEQFSDQEQAQSFRIEVMSFGFKYGIPIDADLVFDVRFLPNPYYLPELRNQTGVDEPVYDYVMNHPESEDFYQHLLALIEPILPSYQKEGKSVLTIAMGCTGGQHRSVAFAKRLVQDLSKNWSVNEGHRDKDRRKETVNRS

SEQ ID NO: 3751 - protein, 236 aa, Streptococcus pneumoniae
  misc_feature (B) LOCATION 1...236
  hypothetical: YES
NKEKAMPVNEYGQMIGESMEGYTPGALPSIDFLEGRYARIEALSVEKHAEDLLAVYGPDTPREMWTYLFQEPVADMGELVSLLNQMLARKDRFYYAIIDKATGKALGTFSLMRIDQNNRVIEVGAVTFSPELRGTRIGTEAQYLLARYIFEELNYRRYEWKCDALNLPSRRVAERLGFVYEGTFRQAVVYKGRTRDTDWLSMIDMDWPQVKDRLETWLRPENFDKNGQQYKSLREL

SEQ ID NO: 3752 - protein, 350 aa, Streptococcus pneumoniae
  misc_feature (B) LOCATION 1...350
  hypothetical: YES
TKEKKIMFEHYSVADLFANLYKKRKANILALIALFALIAVPFTIKAVRNKNTVKDTTSYSTYLIYKITPPKESAKTILNHQIGGYSDFYGKLIDGNLNGAYLFNDVEPSELKKIASELDTTETTLKNSTNDYWWKKLTVYYMIDDAGVGVKILTSSKDANDLLEKKIDGLIEKFKHAYANVKIEKLETINSKELNANGETALGLNVKNLILRLVVIGVVCVILVVMGNVLVYLFNPTINRVGDFSQYQIDFVTEITTIANLADVLSYKNTGQELTIVSSNKAILDKLKQSQEALKGMHFVDLQDVSSLLERDTVLLVEEYGVTRYKKFEQSLQILRNLNRSILGVATFKL

SEQ ID NO: 3753 - protein, 181 aa, Streptococcus pneumoniae
  misc_feature (B) LOCATION 1...181
  hypothetical: YES
KKEKNRNMRKHQLQVHKLTILSMMIALDVVLTPIFRIEGMAPMSSVVNILAGIMMGPVYALAMATVTAFIRMTTQGIPPLALTGATFGALLAGLFYKYGRKFYFSALGEIVGTGIIGSIVSYPVMVLFTGSAAKLSWFIYTPRFFGATLIGTAISFIAFRFLIKQEFFKKVQGYFFAERIE

SEQ ID NO: 3754 - protein, 216 aa, Streptococcus pneumoniae
  misc_feature (B) LOCATION 1...216
  hypothetical: YES
KKENEVVVQLLENWLLKEQEKIQTKYRHLNHISVVEPNILFIGDSIVEYYPLQELFGTSKTIVNRGIRGYQTGLLLENLDAHLYGGAVDKIFLLIGTNDIGKDVPVNEVLNNLEAIIQSVARDYPLTEIKLLSILPVNEGEKYQQAVYIRSNEKIQNWNQAYQELASAYMQVEFVPVFDCLTDQAGQLKKEYTTDGLHLSIAGYQALSKSLKDYLY

SEQ ID NO: 3755 - protein, 210 aa, Streptococcus pneumoniae
  misc_feature (B) LOCATION 1...210
  hypothetical: YES
EKEKCMGWWRETIDIVKENDPAARTTLEVLLTYPGVKALAAHRLSHFLWKYDFKLLARMHSQFWRFWTQIEIHPGAQIDSGVFIDHGSGLVIGETAIVEKGVLLYHGVTLGGTGKDCGKRHPTVRKGALISAHAQVIGPVEIGENAKVGAAAVVVADVPSDVTVVGIPAKIVRLHGKKDEPVIHEVEEKREYYVNKLEQAKDASHRSSGL

SEQ ID NO: 3756 - protein, 265 aa, Streptococcus pneumoniae
  misc_feature (B) LOCATION 1...265
  hypothetical: YES
IHWKTSMATIKEIKELLVTVKELESPIFLDLEKDNRSGVQKEISKRKRAIQAELDENLRLESMLSYEKELYKQGLTLIAGIDEVGRGPLAGPVVAAAVILPKNCKIKGLNDSKKIPKKKHLEIFQAVQDQALSIGIGIIDNQVIDQVNIYEATKLAMQEAISQLSPQPEHLLIDAMKLDLPISQTSIIKGDANSLSIAAASIVAKVTRDELMKEYDQQFPGYDFATNAGYGTAKHLEGLTKLGVTPIHRTSFEPVKSLVLGKKES

SEQ ID NO: 3757 - protein, 131 aa, Streptococcus pneumoniae
  misc_feature (B) LOCATION 1...131
  hypothetical: YES
LXWNXXGEAGPRWCVGGSGWLGFLSLWGAGGRGAGARGSRAGRGWLVALLSVLGCVARSGLWRVGXGRGGGGCVCGGXLXRLVAADLGRLRPAALGGAAGRAPRARVGTGEVGRSTGLEDGVLMLSGAPAX

SEQ ID NO: 3758 - protein, 119 aa, Streptococcus pneumoniae
  misc_feature (B) LOCATION 1...119
  hypothetical: YES
GRWNQRHSSSLRKEKEMIEAQGFLVDKQTRCIHYHSKLDIIALQCYDCKKYYACYRCHDSLENHPFEPYPLSLIQDKPILCGVCLKLLTYKQYKESLSCPFCFSRFNPGCQNHKERYFK

SEQ ID NO: 3759 - protein, 62 aa, Streptococcus pneumoniae
  misc_feature (B) LOCATION 1...62
  hypothetical: YES
SVWKFHQTHTHSTLDVKSSLKQMDAWIVSTKNTVSNNDKRTVSAVLFCFLKSTAVFMFQTHL

SEQ ID NO: 3760 - protein, 248 aa, Streptococcus pneumoniae
  misc_feature (B) LOCATION 1...248
  hypothetical: YES
FRRNIYKGKDRIPAGETFVHELQKRDIPILFVTNNTTRTPESVKEMLAQNFNIDTPISTVYTATLATIDYMNDLGLEKTVYVVGEAGLKEAIKAAGYVEDKEKPAYVVVGLDWQVDYEKFATATLAIQKGAHFIGTNPDLNIPTERGLLPGAGSLITLLEVATRVKPVYIGKPNAIIMDKAVEHLGLEREELIMVGDNYLTDIRAGIDNGIPTLLVTTGFTKAEEVAGLPIAPTHVVSSIAEWDFDEN

SEQ ID NO: 3761 - protein, 71 aa, Streptococcus pneumoniae
  misc_feature (B) LOCATION 1...71
  hypothetical: YES
QTRKLAAGCSKHCFKVVDGTDEVSSKHCFEVVDRTDEVSNHTYGKATLTWFEEIFEEYKSLHNKTHITKVV

SEQ ID NO: 3762 - protein, 324 aa, Streptococcus pneumoniae
  misc_feature (B) LOCATION 1...324
  hypothetical: YES
GSRKSMYPDDSLTLHTDLYQINMMQVYFDQGIHNKKAVFEVYFRQQPFKNGYAVFAGLERIVNYLEDLRFSDSDIAYLESLGYHGAFLDYLRNFKLELTVRSAQEGDLVFANEPIVQVEGPLAQCQLVETALLNIVNYQTLVATKAARIRSVIEDEPLMEFGTRRAQETDAAIWGTRAAVIGGANGTSNVRAGKLFDIPVLGTHAHALVQVYGNDYEAFKAYAATHKNCVFLVDTYDTLRIGVPAAIQVARELGDQINFMGVRIDSGDIAYISKKVRQQLDEAGFTEAKIYASNDLDENTILNLKMQKAKIDVWGVGTTADYSL

SEQ ID NO: 3763 - protein, 749 aa, Streptococcus pneumoniae
  misc_feature (B) LOCATION 1...749
  hypothetical: YES
NGRKNWRVEMPKEVNLTGEEVVALTKEYLTEEDVHFVHKALVYAVECHSGQYRKSGEPYIIHPIQVAGILAKLKLDAVTVACGFLHDVVEDTDATLDDLEREFGPDVRVIVDGVTKLGKVEYKSIEEQLAENHRKMLMAMSEDIRVILVKLSDRLHNMRTLKHLRKDKQERISKETMEIYAPLAHRLGISSVKWELEDLSFRYLNPTEFYKITHMMKEKRREREALVDEVVTKLEEYTTERHLKGKIYGRPKHIYSIFRKMQDKRKRFEEIYDLIAIRCILDTQSDVYAMLGYVHEFWKPMPGRFKDYIANRKANGYQSIHTTVYGPKGPIEFQIRTKEMHEVAEYGVAAHWAYKKGIKGQVNSKESAIGMNWIKEMMELQDQADDAKEFVDSVKENYLAEEIYVFTPDGAVRSLPKDSGPIDFAYEIHTKVGEKATGAKVNGRMVPLTTKLKTGDQVEIIANPNSFGPSRDWLNMVKTSKARNKIRQFFKNQDKELSVNKGREMLMAQFQENGYVANKFMDKRHMDQVLQKTSYKTEDSLFAAIGFGEIGAITVFNRLTEKERREEERAKAKAEAEELVKGGEVKVENKETLKVKHEGGVVIEGASGLLVRIAKCCNPVPGDDIVGYITKGRGVAIHRVDCMNLRAQENYEQRLLDVEWEDQYSSSNKEYLAHIDIYGLNRTGLLNDVLQVLSNTTKNISTVNAQPTKDMKFANIHVSFGIANLSTLTTVVDKIKSVPEVYSVKRTNG

SEQ ID NO: 3764 - protein, 188 aa, Streptococcus pneumoniae
  misc_feature (B) LOCATION 1...188
  hypothetical: YES
IYRKLGWRTSLFLKIRRNMNKKTRQTLIGLLVLLLLSTGSYYIKQMPSAPNSPKTNLSQKKQASEAPSQALAESVLTDAVKSQIKGSLEWNGSGAFIVNGNKTNLDAKVSSKPYADNKTKTVGKETVPTVANALLSKATRQYKNRKETGNGSTSWTPPGWHQVKNLKGSYTHAVDRVIWQSSPRVVDG

SEQ ID NO: 3765 - protein, 170 aa, Streptococcus pneumoniae
  misc_feature (B) LOCATION 1...170
  hypothetical: YES
FCRKSNKETSKVMPYFIGGHPGFNCPLLDDGVYEDYYLESEKEETCSVPRPFPETGMLDFQDRSPWLEGQKEIDLSYDLFSTDAVTLDELQSRTIALRSLKHDKGLKVHFAEFPNLIIWSTLNKGPFITFEPWSGLSTFLEEGDHLEDKKNVCLLEANQVEELGFEIEVL

SEQ ID NO: 3766 - protein, 469 aa, Streptococcus pneumoniae
  misc_feature (B) LOCATION 1...469
  hypothetical: YES
ASRNSYGQDCTHTGSEWLRSDWIRLMTDERIHVLRDILLELHNGASPESVQDRFDATFTGVSAIEISLMEHELMNSDSGVTFEDVMELCDVHANLFKNAIKGVEVSDTEHPGHPVRVFKEENLALRAALIRIRRLLDTYESMEDEEMLAEMRKGLVRQMGLVGQFDIHYQRKEELFFPIMERYGHDSPPKVMWGVDDQIRELFQTALTTAKSLPEVSISSVKEAFEAFATEFESMIFKEESILLMILLESFTQDDWLQIAEESDAYGYAIIRPSEKWVPERQIFIEEKIAEEPVQLDTAEGQVQQVIDTPEGHFTITFTPKEKEAVLDRHSQQAFGNGYLSVEQANLILNHLPMEITFVNKEDIFQYYNDNTPADEMIFKRTPSQVGRNVELCHPPKYLDKVKAIMKGLREGTKDKYEMWFKSESRGKFVHITYAAVHDENGEFQGVLEYVQDIQPYREIDTDYFRGLE

SEQ ID NO: 3767 - protein, 164 aa, Streptococcus pneumoniae
  misc_feature (B) LOCATION 1...164
  hypothetical: YES
RTRNVAFYGLTSVSNWSLSSNISTRLIEVFLIHHLHYTSDQIHEEADVLDNTVSDLFVERLDKLLGFPKTCPHGGTIPAKGELLVEINNLPLADIKEAGAYRLTRVHDSFDILHYLDKHSLHICDQLQVKQFDGFSNTSTILSNDEDLXVNMDIAKQLYVEKIN

SEQ ID NO: 3768 - protein, 107 aa, Streptococcus pneumoniae
  misc_feature (B) LOCATION 1...107
  hypothetical: YES
DERNFRNLMMNMQNMMRQAQKLQKQMEQSQAELAAMQFVGKSAQDLVQATLTGDKKVVSIDFNPAVVDPEDLETLSDMTVQAINSALEQIDETTKKKLGAFAGKLPF

SEQ ID NO: 3769 - protein, 82 aa, Streptococcus pneumoniae
  misc_feature (B) LOCATION 1...82
  hypothetical: YES
IERNYMIYKVFYQETKERSPRRETTRALYLDIDTSSELEGRITARQLVEENRPEYNIEYIELLSDKLLDYEKETGAFEITEF

SEQ ID NO: 3770 - protein, 385 aa, Streptococcus pneumoniae
  misc_feature (B) LOCATION 1...385
  hypothetical: YES
KRRNLYQLKKPIIEFKNVSKVFEDSNTKVLKDINFELEEGKFYTLLGASGSGKSTILNIIAGLLDATTGDIMLDGVRINDIPTNKRDVHTVFQSYALFPHMNVFENVAFPLRLRKIDKKEIEQRVAEVLKMVQLEGYEKRSIRKLSGGQRQRVAIARAIINQPRVVLLDEPLSALDLKLRTDMQYELRELQQRLGITFVFVTHDQEEALAMSDWIFVMNDGEIVQSGTPVDIYDEPINHFVATFIGESNILPGSMIEDYLVEFNGKRFEAVDGGMKPNEPVEVVIRPEDLRITLPEEGKLQVKVDTQLFRGVHYEIIAYDELGNEWMIHSTRKAIVGEEIGLDFEPEDIHIMRLNETEEEFDARIEEYVEIEEQEAGLINAHSRS

SEQ ID NO: 3771 - protein, 332 aa, Streptococcus pneumoniae
  misc_feature (B) LOCATION 1...332
  hypothetical: YES
RVRKSRVNNSQQMLQALEEQDLTKAEHYFAKALENDSSDLLYELATYLEGIGFYPQAKEIYLKIVEDFPEVHLNLAAIASEDGQIEEAFTYLEEIQADSDWYVSSLALKADLYQLEGLTDVAREKLLEALTYSEDSLLILGLAELDSELENYQAAIQAYAQLDNRSIYEQTGISTYQRIGFAYAQLGKFETATEFLEKALELEYDDLTAFELASLYFDQEEYQKATLYFKQLDTISPDFEGYEYGYSQALHKEHQVQEALRIAKQGLEKNPFETRLLLAASQFSYELHDASGAENYLLTAKEDAEDTEEILLRLATIYLEQERYEDILELQS

SEQ ID NO: 3772 - protein, 393 aa, Streptococcus pneumoniae
  misc_feature (B) LOCATION 1...393
  hypothetical: YES
KKRNSMLHYTKEDLLELGAEITTREIYQQPDVWREAFEFYQAKREEIAAFLQEIADKHDYIKVILTGAGTSAYVGDTLLPYFKEVYDERKWNFNAIATTDIVANPATYLKKDVATVLVSFARSGNSPESVATVDLAKSLVDELYQVTITCAADGKLALQAHGDDRNLLLLQPAVSNDAGFAMTSSFTSMMLTTLLVFDPTEFAVKSERFEVVSSLARKVLDKAEDVKELVDLDFNRVIYLGAGPFFGLAHEAQLKILELTAGQVATMYESPVGFRHGPKSLINENTVVLVFGTRTDYTRKYDLDLVREVAGDQIARRVVLLSDQAFGLENVKEVALGCGGVLNDIYRVFPYIVYAQLFALLTSLKVENKPDTPSPTGTVNRVVQGVIIHEYQK

SEQ ID NO: 3773 - protein, 61 aa, Streptococcus pneumoniae
  misc_feature (B) LOCATION 1...61
  hypothetical: YES
FWRKILSLLFIILNLFILYKIYSLRREKSKYLIYTAYIIFGVNVVYGIQWLLKELISTISP

SEQ ID NO: 3774 - protein, 334 aa, Streptococcus pneumoniae
  misc_feature (B) LOCATION 1...334
  hypothetical: YES
IRRNLVMVVFTGSTVEEAIQKGLKELDIPRMKAHIKVISREKKGFLGLFGKKPAQVDIEAISETTVVKANQQVVKGVPKKINDLNEPVKTVSEETVDLGHVVNAIKKIEEEGQGISDEVKAEILKHERHASTILEETGHIEILNELQIEEAMREEAGADDLETEQDQTENQDLKEMGLKVEQSYDIAQVATDVTAYVQAIVDDMDVEATLSNDYNRRSINLQIDTNEPGRIIGYHGKVLKALQLLAQNYLYNRYSKTFYVTINVNDYVEHRAEVLQTYAQKLANRVLEEGRSHKTDPMSNSERKIIHRIISRMDGVTSYSEGDEPNRYVVVDTE

SEQ ID NO: 3775 - protein, 289 aa, Streptococcus pneumoniae
  misc_feature (B) LOCATION 1...289
  hypothetical: YES
TRRNLMLGAIIGDIVGSVYEWNNIKTKDFPLFRKDCFFTDDTVMTCAVAEAIMNGGQKDDFIDAMKKYGRMYPNADYGARFNAWLNSDNREPYNSFGNGSAMRISPCAWIMDCGFYAKTGMWPSSRGLTSLSAEVTHNHPEGVKGAMATADAIFLCRFYFGGYCREYEQSINDNPTECKRRIKDYIEKEYDYNLSQTLDEIRPNYRFNETCQETVPQAIIAFLESRDFEDAIRNAISLGGDSDTLAAITCSIAEAAYGIPDWIKDKAYSYLDEPLKDVVRRWENRIKAY

SEQ ID NO: 3776 - protein, 425 aa, Streptococcus pneumoniae
  misc_feature (B) LOCATION 1...425
  hypothetical: YES
ERRKTKMQNLKFAFSSIMAHKMRSLLTMIGIIIGVSSVVVIMALGDSLSRQVNKDMTKSQKNISVFFSPKKSKDGSFTQKQSAFTVSGKEEEVPVEPPKPQESWVQEAAKLKGVDSYYVTNSTNAILTYQDKKVENANLTGGNRTYMDAVKNEIIAGRSLREQDFKEFASVILLDEELSISLFESPQEAINKVVEVNGFSYRVIGVYTSPEAKRSKIYGFGGLPITTNISLAANFNVDEIANIVFRVNDTSLTPTLGPELARKMTELAGLQQGEYQVADESVVFAEIQQSFSFMTTIISSIAGISLFVGGTGVMNIMLVSVTERTSEIGLRKALGAQRANILIQFLIESMILTLLGGLIGLTIASGLTALAGLLLQGLIEGIEVGVSIPVALFSLAVSASVGMIFGVLPANKASKLDPIEALRYE

SEQ ID NO: 3777 - protein, 120 aa, Streptococcus pneumoniae
  misc_feature (B) LOCATION 1...120
  hypothetical: YES
FLGNGNQCLCSRFGCQGGDHQLRLGKWSLVRKPDLDRPVHCLPRFSSHQFLVYSGLRFIPYHSGPSSGVFIKYLYGPNSLRSYGANLSTQYVCRHQQSRVCYGETAFNLWRIWLGYCDRN

SEQ ID NO: 3778 - protein, 171 aa, Streptococcus pneumoniae
  misc_feature (B) LOCATION 1...171
  hypothetical: YES
LSGNTTALSQSLSVTPNNGVSAADDGYVFNPNDIVRDTGDAYIVRHGDHYHYIPKSSLNNPPSHSNTEEAGSSSSSVLSNPSLHVHHEEEDGHGFDANRIISEDSEGFVIPHGDHNHYIKVQTKGYEAALKNKIPSLQSNYQPGTFDEKAVLAKVDQLLADSRSIYKDRLS

SEQ ID NO: 3779 - protein, 214 aa, Streptococcus pneumoniae
  misc_feature (B) LOCATION 1...214
  hypothetical: YES
RKGKSVTMANVTLFDQTGKEAGQVVLSDAVFGIEPNESVVFDVIISQRASLRQGTHAVKNRSAVSGGGRKPWRQKGTGRARQGSIRSPQWRGGGVVFGPTPRSYGYKLPQKVRRLALKSVYSEKVAENKFVAVDALSFTAPKTAEFAKVLAALSIDSKVLVILEERNEFAALSARNLPNVKIATATTASFPDIANSDKLLVTQAAISKIEEVLA

SEQ ID NO: 3780 - protein, 64 aa, Streptococcus pneumoniae
  misc_feature (B) LOCATION 1...64
  hypothetical: YES
MKGKEYENRTVSFAISSKGEKMKVENISYRVDHRILFDNISFDTSSSGVTLITGKNGTGKSTLL

SEQ ID NO: 3781 - protein, 82 aa, Streptococcus pneumoniae
  misc_feature (B) LOCATION 1...82
  hypothetical: YES
ITNLLIFSPEGGINFDHKIGYSLYPENMLRMIVSKQYLLFYLIHEKEVHTLRIINSRTDYLNQLDHLFRTCRKLFSSQIISL

SEQ ID NO: 3782 - protein, 95 aa, Streptococcus pneumoniae
  misc_feature (B) LOCATION 1...95
  hypothetical: YES
EPNLKTSLILFENLFKPRQRRLTVYMLLTSSVLSATSKRCFELTSSVSSTTSKPCFELTSSVSSTTSKQCFEQPAVSFLVCSLIFIEYKFSLEKA

SEQ ID NO: 3783 - protein, 106 aa, Streptococcus pneumoniae
  misc_feature (B) LOCATION 1...106
  hypothetical: YES
LQNLINDLLHRRSIDSSMSVDTVRRPHTCVEETQIVIDFSRRSHRRARIFTSRFLVDGNSWAETINGIYIWFFHISQELTSVGGQTLYIATLSLRIESIKSQTGLP

SEQ ID NO: 3784 - protein, 63 aa, Streptococcus pneumoniae
  misc_feature (B) LOCATION 1...63
  hypothetical: YES
FVFELVAFVDEDVSDELLVLEFDVLELGATGFVVTFIIVSNGVITAGKTTPLRSIACKGTEPL

SEQ ID NO: 3785 - protein, 221 aa, Streptococcus pneumoniae
  misc_feature (B) LOCATION 1...221
  hypothetical: YES
IGFEELEMKVLVTGFEPFGGEKGNPALEAIKGLPAEIHGAEVRWLEVPTVFHKSAQVLEEEMNRYQPDFVLCIGQAGGRTSLTPERVTINQDDACISDNEDNQPIDRPIRPDGASAYFSSLPIKAMVQAIKKEGLPASVSNTAGTFVCSHLMYQALYLVEKKSPYVKAGFMHIPYMMEQVVNRPTTPAMSLVDIRRGIEAAIGAIIEHGDQELKLVGGETH

SEQ ID NO: 3786 - protein, 136 aa, Streptococcus pneumoniae
  misc_feature (B) LOCATION 1...136
  hypothetical: YES
NSFEKYVQEHKILLSIFDLDETVTDYYGKLESFLEENSSIDGIFTINDFTALDVIEILEKNGKRIPHDVQIIGYDGIKMAGDRDYLLSTIEQPLEEMAKEAVRILFDIIDGKTVNLQTILPVKFVEGKTTKNENKS

SEQ ID NO: 3787 - protein, 100 aa, Streptococcus pneumoniae
  misc_feature (B) LOCATION 1...100
  hypothetical: YES
IKFDKRTLSYYRGEEMDPKKIARINELAKKKKTEGLTPEEKVEQAKLREEYIEGYRRAVRHHIEGIKIVDEERNDVTPEKLRQVQREKGLHGRSLDDPNS

SEQ ID NO: 3788 - protein, 511 aa, Streptococcus pneumoniae
  misc_feature (B) LOCATION 1...511
  hypothetical: YES
RKFEIESGVLLAINAQEISALIKQQIENFKPNFDVTETGVVTYIGDGIARAHGLENAMSGELLNFENGSYGMAQNLESTDVGIIILGDFTDIREGDTIRRTGKIMEVPVGESLIGRVVDPLGRPVDGLGEIHTDKTRPVEAPAPGVMQRKSVSEPLQTGLKAIDALVPIGRGQRELIIGDRQTGKTTIAIDTILNQKDQDMICIYVAIGQKESTVRTQVETLRQYGALDYTIVVTASASQPSPLLFLAPYAGVAMAEEFMYQGKHVLIVYDDLSKQAVAYRELSLLLRRPPGREAFPGDVFYLHSRLLERSAKVSDELGGGSITALPFIETQAGDISAYIATNVISITDGQIFLGDGLFNAGIRPAIDAGSSVSRVGGSAQIKAMKKVAGTLRIDLASYRELEAFTKFGSDLDAATQAKLNRGRRTVEVLKQPVHKPLPVEKQVTILYALTHGFLDTVPVDDIVRFEEEFHAFFDAQHPEILETIRDTKDLPEEAVLDAAITEFLNQSSFQ

SEQ ID NO: 3789 - protein, 78 aa, Streptococcus pneumoniae
  misc_feature (B) LOCATION 1...78
  hypothetical: YES
VRFEDILSSFILFPTSHTFITYIYHIHTPLIKRIAHSCHNFLNKKIMTKQGSNLLMLLKNLKLMSSYQKSYLQPQNST

SEQ ID NO: 3790 - protein, 298 aa, Streptococcus pneumoniae
  misc_feature (B) LOCATION 1...298
  hypothetical: YES
MRFEFIADEHVKVKTFLKKHEVSKGLLAKIKFRGGAILVNNQPQNATYLLDVGDYVTIDIPAEKGFETLEAIELPLDILYEDDHFLVLNKPYGVASIPSVNHSNTIANFIKGYYVKQNYENQQVHIVTRLDRDTSGLMLFAKHGYAHARLDKQLQKKSIEKRYFALVKGDGHLEPEGEIIAPIARDEDSIITRRVAKGGKYAHTSYKIVASYGNIHLVYIHLHTGRTHQIRVHFSHIGFPLLGDDLYGGSLEDGIQRQALHCHYLSFYHPFLEQDLQLESPLPDDFSNLITQLSTNTL

SEQ ID NO: 3791 - protein, 106 aa, Streptococcus pneumoniae
  misc_feature (B) LOCATION 1...106
  hypothetical: YES
LFLDKGRNSGEEVRMKKFDNYIIEKPCDSNSDKLQKILIIENLVDDILQFSLRINNSVGEIFLLQPFQKKTIFIPCYFEEDIVKVKDDDKVEWNLLEFQKFRAFLA

SEQ ID NO: 3792 - protein, 257 aa, Streptococcus pneumoniae
  misc_feature (B) LOCATION 1...257
  hypothetical: YES
RRLDRQRLHQRICEIMTEIRLEHVSYAYGQERILEDINLQVTSGEVVSILGPSGVGKTTLFNLIAGILEVQSGRIVLDGEENPKGRVSYMLQKDLLLEHKTVLGNIILPLLIQKVDKAEAISRADKILATFQLTAVRDKYPHELSGGMRQRVALLRTYLFGHKLFLLDEAFSALDEMTKMELHAWYLEIHKQLQLTTLIITHSIEEALNLSDRIYILKNRPGQIVSEIKLDWSEDEDKEVQKIAYKRQILAELGLDK

SEQ ID NO: 3793 - protein, 325 aa, Streptococcus pneumoniae
  misc_feature (B) LOCATION 1...325
  hypothetical: YES
SMLDWKQFFLAYLRSRSRLFIYLLSLAFLVLLFQFLFASLGIYFLYFFFLCCFVTILFFTWDILVETQVYRQELLYGEREAKSPLEIALAEKLEAREMELYQQRSKAERKLTDLLDYYTLWVHQIKTPIAASQLLVAEVVDRQLKQQLEQEIFKIDSYTNLVLQYLRLESFHDDLLLKQVQIEDLVKEIIRKYALFFIQKGLNVNLHDLDKEIVTDKKWLLVVIEQIISNSLKYTKEGGLEIYMDDQELCIKDTGIGIKNSDVLRVFERGFSGYNGRLTQQSSGLGLYLSKKISEELGHQIRIESEVGKGTTVRIQFAQVNLVLE

SEQ ID NO: 3794 - protein, 355 aa, Streptococcus pneumoniae
  misc_feature (B) LOCATION 1...355
  hypothetical: YES
VLIDQTERSDEMVTERQQDILNLIIDIFTKTHEPVGSKALQESINSSSATIRNDMAELEKQGLLEKAHTSSGRMPSVAGFQYYVKHSLDFDRLAENEVYEIVKAFDQEFFKLEDILQEAANLLTDLSGCTVVALDVEPSRQRLTAFDIVVLGQHTALAVFTLDESRTVTSQFLIPRNFLQEDLLKLKSIIQERFLGHTVLDIHYKIRTEIPQIIQRYFTTTDNVIDLFEHIFKEMFNENIVMAGKVNLLNFANLAAYQFFDQPQKVALEIREGLREDQMQNVRVADGQESCLADLAVISSKFLIPYRGVGILAITGPVNLDYQQLINQVNVVNRVLTMKLTDFYRYLSSNHYEVH

SEQ ID NO: 3795 - protein, 266 aa, Streptococcus pneumoniae
  misc_feature (B) LOCATION 1...266
  hypothetical: YES
FSIEQFSLKGKIALITGASYGIGFAIAKSYAEAGATIVFNDINQDLVNKGIEAYREVGIEAHGYVCDVTDEDGIQAMVKQIEQEVGVIDILVNNAGIIRRVPMCEMSAADFRKVIDIDLNAPFIVSKAVIPSMIKKGHGKIINICSMMSELGRETVSAYAAAKGGLKMLTRNIASEYGGANIQCNGIGPGYIATPQTAPLRELQEDGSRHPFDQFIIAKTPAARWGNPEDLMGPAVFLASDASNFVNGHILYVDGGILAYIGKQPE

SEQ ID NO: 3796 - protein, 202 aa, Streptococcus pneumoniae
  misc_feature (B) LOCATION 1...202
  hypothetical: YES
KEIEKNVLPGEKLYEIGSKYNQIFPRPVFFFVFKKEFGGNENFRKTGLSKVKGKLFQQDVVKGGNKRFYRPTFRMHLTNKEILDKILSYSEDLKHHYQIYQLLLFHFQNKDPEKFFGLIEDTLKQVHPIFQTVFKTFLKNKEKIVNALQLPYSNAKLEATNNLIKLIKRNAFGFRNFENFKKRIFIALNIKKERTNFVLSRA

SEQ ID NO: 3797 - protein, 107 aa, Streptococcus pneumoniae
  misc_feature (B) LOCATION 1...107
  hypothetical: YES
KRIDMSIELLKKLTGEEDTQLLMLLQTRATNLILSETNRTSLTPALSLLIPEVAIELHNRSGAEGEHSRTEGGIAVVYGENGLSTDLLQRIRMHRLARVAGHVFEAE

SEQ ID NO: 3798 - protein, 108 aa, Streptococcus pneumoniae
  misc_feature (B) LOCATION 1...108
  hypothetical: YES
TTDLLINESIVTTEARAKEIRKTVEKMITLGKRGDLHARRQAAAFVRNEIASENYDEATDKYTSTTALQKLFSEIAPRYAERNGGYTRILKTEPRRGDAAPMAIIELV

SEQ ID NO: 3799 - protein, 75 aa, Streptococcus pneumoniae
  misc_feature (B) LOCATION 1...75
  hypothetical: YES
VVSDYLCCLYGSRIYFLLYQANQEKVILILFENLFKPRQFPSATSKHCFEQPAASFLVCSLIFIEYKIQGIHFRI

SEQ ID NO: 3800 - protein, 300 aa, Streptococcus pneumoniae
  misc_feature (B) LOCATION 1...300
  hypothetical: YES
LFPDLVFQYDPCKGAFPMDKPDIATIIDSHFEEMTDLEQEIARYFLQAETITDDLSSQQVTQKLHISQAALTRFAKKCGFTGYREFIFQYQHQAENQANQVSKHSPLTKRVLRSYSNMREQTQDLIDEIQLERIAQLIEDAERIYFFGTGSSGLVAREMKLRFMRLGVVCEALTDQDGFAWTTSIMDENCLVLGFSLSGSTPSILDSLLDAKEMGAKTVLFTSVPNKDSQTYTETVLVATHSQPSYIQRISAQLPMLFFIDLIYAYFLEINRESKEKIFNSYWENKKLNGYRRQKRVRKS

SEQ ID NO: 3801 - protein, 113 aa, Streptococcus pneumoniae
  misc_feature (B) LOCATION 1...113
  hypothetical: YES
RLTESASCCSLVLMSTTFTLISTISKSVILATSEDTISLISEYKAGTFFWYSTITFKSTATCVLPTSTLTPLVTSSLLTIFSLRFEKKPPSIPKRPETFSSERPMIFWITLSS

SEQ ID NO: 3802 - protein, 309 aa, Streptococcus pneumoniae
  misc_feature (B) LOCATION 1...309
  hypothetical: YES
ERTENIMTEKLQLTKSDRKKVWWRSTFLQGSWNFERMQNLGWAYTLIPAIKKLYTKKEDQIAALERHLEFFNTHPYVAAPVMGVTLALEEERANGVEIDDAAIQGVKIGMMGPLAGIGDPVFWFTVRPILGSLGASLALTGNILGPLLFFVAWNLIRMSFLWYVQEIGYKAGSEITKDMSGGILQDITKGASILGMFILAVLVQRWVNIKFAFDVSKVQLDEKAYIHWDKLPEGSKGIQEAFAQVGQGLSQTPEKVTTFQQNLDMLIPGLSGLLLTLLCMYLLKKKVSPITIILALFAVGIVAHVLHIM

SEQ ID NO: 3803 - protein, 231 aa, Streptococcus pneumoniae
  misc_feature (B) LOCATION 1...231
  hypothetical: YES
WRTEMKNINGKKVTIYDIARLSGFSPKTVSRVINGGVNVKEETYQAIQKVIEELSYIPNAYAKNLTKKEAINILISVKKIDSFPLIWFHTLLDKVLRTCKEFGVNAIVEYFGEEDTISNSIISSTGSLVDGVIVFYESVDDIRIQYLKKNHMPFLVFGESQTSGVVYVSNNNFQATYDMMKAVTEEKFKNMWLLMGGESHVNKDRERGVRSFLNDKNYFMDLKVILWLIYN

SEQ ID NO: 3804 - protein, 436 aa, Streptococcus pneumoniae
  misc_feature (B) LOCATION 1...436
  hypothetical: YES
TEADEGMQAARAALPAWRALSAIERAAYLHKTAAILERDKEKIGTILAKEIAKGIKAAIGEVVRTADLIRYAAEEGLRITGQAMEGGGFEAASKNKLAVVRREPVGIVLAIAPFNYPVNLSASKIAPALIAGNVVMFKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 3805 - protein, 206 aa, Streptococcus pneumoniae
  misc_feature (B) LOCATION 1...206
  hypothetical: YES
AQAETVSQTVSLPNAKIVLDRFHIVQHLSRAMSRVRVQIMNQFHRKSHEYKAIKRYWKLIQQDSRKLSDKRFYRPTFRMHLTNKEILDKLLSYSQDLKHHYQLYQLLLFHFQNKEPEKFFGLIEDNLKQVHPLFQTVFKTFLKDKEKIVNALQLHYSNAKLEATNNLIKLIKRNAFGFRNFENFKKRIFIALNIKKERTKFVLSRA

SEQ ID NO: 3806 - protein, 206 aa, Streptococcus pneumoniae
  misc_feature (B) LOCATION 1...206
  hypothetical: YES
AQAETVSQTVSLPNAKIVLDRFHIVQHLSRAMSRVRVQIMNQFHRKSHEYKAIKRYWKLIQQDSRKLSDKRFYRPTFRMHLTNKEILDKLLSYSQDLKHHYQLYQLLLFHFQNKEPEKFFGLIEDNLKQVHPLFQTVFKTFLKDKEKIVNALQLHYSNAKLEATNNLIKLIKRNAFGFRNFENFKKRIFIALNIKKERTKFVLSQA

SEQ ID NO: 3807 - protein, 198 aa, Streptococcus pneumoniae
  misc_feature (B) LOCATION 1...198
  hypothetical: YES
AQAETVSQTVSLPNAKIVLDRFHIVQHLSRAMSRVHVQIMNQFHRKSHEYKAIKRYWKLIQQDSRKLSDKRFYRPTFRMHLTNKEILNKLLSYSEDLKHHYQLYNKEPEKFFGLIEDNLKQVHPIFQTVFKTFLKDKEKIVNALQLPYSNAKLEATNNLIKLIKRNAFGFRNFENFKKRIFIALNIKKERTKFVLSQA

SEQ ID NO: 3808 - protein, 84 aa, Streptococcus pneumoniae
  misc_feature (B) LOCATION 1...84
  hypothetical: YES
AQAETVSQTVSLPNAKIVLDRFHIVQHLSRAMSRVRVQIMNQFHRKSHEYKAIKRYWKLIQQDSRKLSDKRFYRPTFRMHLTNK

SEQ ID NO: 3809 - protein, 206 aa, Streptococcus pneumoniae
  misc_feature (B) LOCATION 1...206
  hypothetical: YES
AQAETVSQTVSLPNAKIVLDRFHIVQHLSRAMSRVRVQIMNQFHRKSHEYKAIKRYWKLIQQDSRKLSDKRFYRPTFRMHLTNKEILNKLLSYSQDLKHHYQLYQLLLFHFQNKEPEKFFELIEDNLKQVHPIFQTVFKTFLKDKEKIINALQLHYSNAKLEATNNLIKLIKRNAFGFRNFENFKKRIFIALNIKKERTKFVLSRA

SEQ ID NO: 3810 - protein, 409 aa, Streptococcus pneumoniae
  misc_feature (B) LOCATION 1...409
  hypothetical: YES
VGAEKFSQPHFLKWTYRKVLQDCNMKKEFNLIATVAAGLEAVVGREVREMGYDCQVENGRVRFQGDVRAIIETNLWLRAADRIKIIVGTFPAKTFEELFQGVFALDWENYLPLGARFPISKAKCVKSKLHNEPSVQAISKKAVVKKLQKHYARPEGVPLMENGPEFKIEVSILKDVATVMIDTTGSSLFKRGYRTEKGGAPIKENMAAAILQLSNWYPDKTLIDPTCGSGTFCIEAVMIARKMAPGLRRSFAFEEWNWISDRLIQEVRTEAAKKVDRELELDIMGCDIDARMVEIAKANAQAAGVAGDITFKQMRVQDLRSDKINGVIISNPPYGERLSDDAGVTKLYAEMGQVFAPLKTWSKFILTSDEAFESKYGSQADKKRKLYNGTLKVDLYQYFGQRVKRQEVK

SEQ ID NO: 3811 - protein, 299 aa, Streptococcus pneumoniae
  misc_feature (B) LOCATION 1...299
  hypothetical: YES
RAYEVFCENNLNITFFDTFSEIKNNIDYYIIALPTDYDEKIGSFNTYEIEQTVSKILRVKPNGKIILKSTVPIGFSNKLKRLFDTKNIIFVPEFLREGCSIYDNLYPSRIVVGDETVEGRKIAELFLSISTHSTANIKNVMLVSPTEAEAIKLFSNTFLALRVAFFNELDSFAERRSLNAEVVIKGVCLDPRIGNFYNNPSFGFGGYCLPKDTKQLKKEFIEINAPVIEAIDISNTNRKQFIVKQILERKPKIVGIYKLGMKYNSDNYKESAILSIINELLIVGIKILVYEPNLNVSYR

SEQ ID NO: 3812 - protein, 208 aa, Streptococcus pneumoniae
  misc_feature (B) LOCATION 1...208
  hypothetical: YES
QTYETRTVIVATGSKHRPLGVPGEEELNSRGVSYCAVCDGAFFRDQDLLVVGGGDSAVEEALFLTRFAKTVTIVHRRDQLRAQKVLQDRAFANEKISFIWDSVVREIKGENRVESVVFENVKTGQVTEQVFGGVFIYVGLDPLSDFVKELNIQDQAGWIVTDNHMKTAVDGIFAVGDVRLKDLRQVTTAVGDGAIAGQEAYKFITEHS

SEQ ID NO: 3813 - protein, 218 aa, Streptococcus pneumoniae
  misc_feature (B) LOCATION 1...218
  hypothetical: YES
KGDLMTLPVRKSLHDAVLQASKADTWEQATKEWNEVSFIFNGIGRSNCVCGNAIKYAYELFNGVTGQRLFPIGSDCVRHFHRLPLDQQLEEEEKLLRKVENLTRKAQKKEKIKVNKSDFDERLLKWLWEKGVFKPNRGNQFAPERDYQLFLEVFQGGSWTKAEPKKKARMEEVLEKCIKPFLLGKSDDQLYLVKLGKEKIDYEQELPYPGRERTQEEG

SEQ ID NO: 3814 - protein, 458 aa, Streptococcus pneumoniae
  misc_feature (B) LOCATION 1...458
  hypothetical: YES
LHHEKVGFIMKIILVGGGKVGFALCRSLVAEKHDVLLIEQDEAVLNHIVSRFDIIGILGNGADFAILEQASVQDCDIFIALTEHDEVNMIAAVLAKKMGAKETIVRVRNPEYSNSYFKEKNILGFSLIVNPELLAARAIANIIDFPNALSVERFAGGRVSLMEFVVKSTSGLCQMPISDFRKKFGNVIVCAIEREHQIIIPSGDMTVQDKDRIFVTGNRVDMILFHNYFKSRAVKSLLIVGAGRIAYYLLGILKDSRIDTKVIEINPEIASFFSEKFPNLYIVQGDGTAKDILLEESAQHYDAVATLTGVDEENLITSMFLDRVGVQKNITKVNRTSLLEIINAPDFSSIITPKSIAVDTIMHFIRGRVNAQYSDLQAMHHLANGQIETLQFHIKEANKMTAKPLSQLKLKKGVLIAAIIRKGKTIFPTGEDMLEVGDKLLVTTLLPNITKIYDLIAR

SEQ ID NO: 3815 - protein, 429 aa, Streptococcus pneumoniae
  misc_feature (B) LOCATION 1...429
  hypothetical: YES
KLDLLPLLDQRPQDLSGGQKQRVSLAGVLIDESPILLFDEPLANLDPKSGQDIIELIDQIHKEEGTTTLIIEHRLEDVLHRPVDRIILINDGRILFNGSPDQLLATDLLTQNGIREPLYLTTLRQLGVDLVKEEQLANLDNMSISKGQVQLQNELAKETPELQSLFKLEDVSFSYDDRPILKSLHLDIKKGEKIAIVGKNGAGKSTLAKAISSFIQTEGRYLWEKQDIKGDSVAERAERVGYVLQNPNQMISTNMIFDEVALGLRLRGVDEKEIETRVYETLKICGLYEFRNWPISALSFGQKKRVTIASILVLGAEIIFLDEPTAGQDQKNYTEIMEFLEELHQKGHTIVMITHDMQLMLDYSDRVLVMVDGELIADTVPASLLSDPELLVKANLKETSIFNLAKKLDVDPLDLTAFYKERREGCKLN

SEQ ID NO: 3816 - protein, 262 aa, Streptococcus pneumoniae
  misc_feature (B) LOCATION 1...262
  hypothetical: YES
GVHERSMIQSITSQGLVLYNRNFREDDKLVKIFTEQVGKRMFFVKHAGQSKLAPVIQPLVLARFLLRINDDGLSYIEDYHEVMTFPKINSDLFVMAYATYVAALADASLQDNQQDAPLFAFLQKTLELMEAGLDYQVLTNIFEIQILTRFGISLNFNECVFCHRVGQAFDFSFKYGACLCPEHYHEDKRRCHLNPNIPYLLNQFQAIDFETLETISLKPGIKQELRQFMDQLYEEYVGIHLKSKKFIDSLADWGQLLKEEKK

SEQ ID NO: 3817 - protein, 97 aa, Streptococcus pneumoniae
  misc_feature (B) LOCATION 1...97
  hypothetical: YES
FLNERDITSRHINSDDFNFFSSFFRVLEEMISDGCLTSVIKNGHDFLSVEILSNESQFPLLVGEFIPGEDFRQSGVILLEMKLLELTIDGRGRGRDG

SEQ ID NO: 3818 - protein, 97 aa, Streptococcus pneumoniae
  misc_feature (B) LOCATION 1...97
  hypothetical: YES
RYNEEKSSKEKELTNSKYITCLKRSEGQLCGIQKMIEGDRDCADIVTQLTAVKSSVERVIEMIITENLTECINQPLDDSEAQKERLEKAIRYLIKRK

SEQ ID NO: 3819 - protein, 436 aa, Streptococcus pneumoniae
  misc_feature (B) LOCATION 1...436
  hypothetical: YES
LENEGGGFCXXFXXXXXXXFXXPRXXXXXXXXXXXXFLQNRATILEFLYRNPATSRTDIVNETGLTPATTTNIIKELSEQSLIYETGDEFSEFSGSGRRRKTISITDNIPYVVGGIEINVLGIFLSLCDLQGKTLFETEILNEDYPISEINSTITNMIKTAIEYVPLETKLLGFGLSIPGHYYKDSGSIITNNPIWESFNLLNVIKRFNFPFIVKNNIDCMAIGQYLFNPHNTPDNFIFLHAGLGIYTSFFTKEKIGASKNPYIGEIGHTIVELNGQYCECGKKGCLQTYISDAWLIKHAQLLFKNSQLTVLKSLVKTEKDIHLDTLLTAYNLGDSALRQQIDKGVNLLATSIANLLLINPADKIYINSQLLNYQPFTHEVRDKIQDQLHFVPFTRNIEIEILPYNKHRGSIGACALAIVAFFIEHSNVLQDIISP

SEQ ID NO: 3820 - protein, 218 aa, Streptococcus pneumoniae
  misc_feature (B) LOCATION 1...218
  hypothetical: YES
KRNELDMSKGFLVSLEGPEGAGKTSVLEALLPILEEKGVEVLTTREPGGVLIGEKIREVILDPSHTQMDAKTELLLYIASRRQHLVEKVLPALEAGKLVIMDRFIDSSVAYQGFGRGLDIEAIDWLNQFATDGLKPDLTLYFDIEVEEGLARIAANSDREVNRLDLEGLDLHKKVRQGYLSLLDKEGNRIVKIDASLPLEQVVETTKAVLFDGMGLAK

SEQ ID NO: 3821 - protein, 172 aa, Streptococcus pneumoniae
  misc_feature (B) LOCATION 1...172
  hypothetical: YES
GGNDMDKKERQKIEQQRREMALTNTFFNRYLLLRYSIALFFFGNIYWLLNQFINPSPIIIFPIMLIVFSILATVEQFKLYGNRKEKLGITLMFVRIQMLISIGLLVLTWTSWFKNLFPIFENNQVARLFVFVVLLLGLVLSLLDIRRIKKIYKRTDKVYQQFVQLEKNSLSL

SEQ ID NO: 3822 - protein, 134 aa, Streptococcus pneumoniae
  misc_feature (B) LOCATION 1...134
  hypothetical: YES
EANEESKMKEAIIEWKDFSFRYETQQEPTLQGIDLTIYKGEKVLIVGPSGSGKSTLGQCLNGIIPNIYKGQTYGEFLIKGQTAFDMSIYDKSHLVSTVLQDTDGQFIGLSVAEDLAFALENDVTALDEMKGSCL

SEQ ID NO: 3823 - protein, 376 aa, Streptococcus pneumoniae
  misc_feature (B) LOCATION 1...376
  hypothetical: YES
SFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEQGTIMKQSPGAGTTYDVSKPTQIVLTVAKKVTSVAMPSYIGSSLEFTKNNLSQIVGIKEANIEVVEVTTAPAGSVEGMVVEQSPRAGEKVDLNKTRVKISIYKPKTTSATP

SEQ ID NO: 3824 - protein, 75 aa, Streptococcus pneumoniae
  misc_feature (B) LOCATION 1...75
  hypothetical: YES
KGDEEQTKIQAGIPTDNEVSYALIYQQETLPATGSSTSALTALGLLAVGSLVLLVRNSFLLPLKSHHLMAFFYIG

SEQ ID NO: 3825 - protein, 62 aa, Streptococcus pneumoniae
  misc_feature (B) LOCATION 1...62
  hypothetical: YES
FVDDIFDGIPVNGFVVSFHLKSLSVFSIANSQLFLLYHNSIGVSHKKSEARLLKCYINYVMT

SEQ ID NO: 3826 - protein, 352 aa, Streptococcus pneumoniae
  misc_feature (B) LOCATION 1...352
  hypothetical: YES
MKDDQKYLLAGLYSLLVAIFYFPLIESKGIFVSILMAVLLLYLIYFIATVIHIVIIKFIRKKSFKYLVLYPFTYDGSWRFQPINLLYFPEMVRDVIPINLVQEYCQGQPYGLLKKMLKRIRLSREISLLLATIIVYFFTHRILPLSVFTFIFSYILLFVQSYLGSNTAWIGNRRLIIDDEFEKILLSKSYIKEISSARYSEYLTCEYKNLTPIILIAIFENLLDSYLLQNQSEVDLDIFYKVLPLLYKEKYTMGFNYFVSLNYLLYKVGFLGIIYDNEALRDLSKQYLNKNISELQDGSFEGGIQDAVASKQIVVINEFIACLNSRCVPSQYDRFFYKDRPYIFSRKSPIKG

SEQ ID NO: 3827 - protein, 265 aa, Streptococcus pneumoniae
  misc_feature (B) LOCATION 1...265
  hypothetical: YES
KGDELMVYTSLSSKDGNYPYQLNIAHLYGNLMNTYGDNGNILMLKYVAEKLGAHVTVDIVSLHDDFDENHYDIAFFGGGQDFEQSIIADDLPAKKESIDNYIQNDGVVLAICGGFQLLGQYYVEASGKRIEGLGVMGHYTLNQTNNRFIGDIKIHNEDFDETYYGFENHQGRTFLSDDQKPLGQVVYGNGNNEEKVGEGVHYKNVFGSYFHGPILSRNANLAYRLVTTALKKKYGQDIQLPAYEDILSQEIAEEYSDVKSKADFS

SEQ ID NO: 3828 - protein, 133 aa, Streptococcus pneumoniae
  misc_feature (B) LOCATION 1...133
  hypothetical: YES
KNCEEKKMAKTIHTDKAPKAIGPYVQGKIVGNLLFASGQVPLSPETGEIVGENIQEQTEQVLKNIGAILAEAGTDFDHVVKTTCFLSDMNDFVPFNEVYQTAFKEEFPARSAVEVARLPRDVKVEIEVIAEIG

SEQ ID NO: 3829 - protein, 218 aa, Streptococcus pneumoniae
  misc_feature (B) LOCATION 1...218
  hypothetical: YES
KGCDFVKDKQFAIPKATAKRLSLYYRIFKRFHAEKIERANSKQIAEAIGIDSATVRRDFSYFGELGRRGFGYDVKKLMTFFADLLNDNSITNVMLVGIGNMGHALLHYRFHERNKMKIIMAFDLDDHPEVGTQTPDGIPIYGISQIKDKIKDADVKTAILTVPSVKSQEVANLLVDAGVKGILSFSPVHLHLPKDVVVQYVDLTSELQTLLYFMRKED

SEQ ID NO: 3830 - protein, 71 aa, Streptococcus pneumoniae
  misc_feature (B) LOCATION 1...71
  hypothetical: YES
DCCETMRVAALNSSIIGSFRSRAPQVADGGTGALNVVNRIGRLARLTSNGVLHTRHALTVNGHNAQLRTFV

SEQ ID NO: 3831 - protein, 175 aa, Streptococcus pneumoniae
  misc_feature (B) LOCATION 1...175
  hypothetical: YES
CRCDRISGEFIMRQLKRVGVFLLLPFFVLIDAHISQLLGSFFPHVHLASHFLFLFLLFETIEVSEYLYLVYCFVIGLVYDVYFFHLIGITTLLFILLGAFLHKLNSVILLNRWTRMLAMIVLTFLFEMGSYLLAFMVGLTVDSMSIFIVYSLVPTMILNFLWITVFQFIFEKYYL

SEQ ID NO: 3832 - protein, 853 aa, Streptococcus pneumoniae
  misc_feature (B) LOCATION 1...853
  hypothetical: YES
ILCEKDKFSCEFAYFKNFLFSLGILWALYLMSNIQNMSLEDIMGERFGRYSKYIIQDRALPDIRDGLKPVQRRILYSMNKDSNTFDKSYRKSAKSVGNIMGNFHPHGDSSIYDAMVRMSQNWKNREILVEMHGNNGSMDGDPPAAMRYTEARLSEIAGYLLQDIEKKTVPFAWNFDDTEKEPTVLPAAFPNLLVNGSTGISAGYATDIPPHNLAEVIDAAVYMIDHPTAKIDKLMEFLPGPDFPTGAIIQGRDEIKKAYETGKGRVVVRSKTEIEKLKGGKEQIVITEIPYEINKANLVKKIDDVRVNNKVAGIAEVRDESDRDGLRIAIELKKDANTELVLNYLFKYTDLQINYNFNMVAIDNFTPRQVGIVPILSSYIAHRREVILARSRFDKEKAEKRLHIVEGLIRVISILDEVIALIRASENKADAKENLKVSYDFTEEQAEAIVTLQLYRLTNTDVVVLQEEEAELREKIAMLAAIIGDERTMYNLMKKELREVKKKFATPRLSSLEDTAKAIEIDTASLIAEEDTYVSVTKAGYIKRTSPRSFAASTLEEIGKRDDDRLIFVQSAKTTQHLLMFTSLGNVIYRPIHELADIRWKDIGEHLSQTITNFETNEEILYVEVLDQFDDATTYFAVTRLGQIKRVERKEFTPWRTYRSKSVKYAKLKDDTDQIVAVAPIKLDDVVLVSQNGYALRFNIEEVPVVGAKAAGVKAMNLKEDDVLQSGFICNTSSFYLLTQRGSLKRVSIEEILATSRAKRGLQVLRELKNKPHRVFLAGAVAEQGFVGDFFSTEVDVNDQTLLVQSNKGTIYESRLQDLNLSERTSNGSFISDTISDEEVFDAYLQEVVTEDK

SEQ ID NO: 3833 - protein, 199 aa, Streptococcus pneumoniae
  misc_feature (B) LOCATION 1...199
  hypothetical: YES
GTRDTSRKVLSLLQDEGLIKGIPGQGSQVVKEETVYFPVSNLTSYQELVKELGLRSKTNVVSLDKIIIDKKSSLITGFPEFRMVWKVVRQRVVDDLVSVLDTDYLDMELIPNLTRQIAEQSIYSYIENGLKLLIDYAQKEITIDHSSDRDKILMDIGKDPYVVSIKSKVYLQDGRQFQFTESRHKLEKFRFVDFAKRKK

SEQ ID NO: 3834 - protein, 242 aa, Streptococcus pneumoniae
  misc_feature (B) LOCATION 1...242
  hypothetical: YES
SMRDANRGGCSQSCRWKYDLYDMPFGKERKSLQGEIPEEFSMSAVDMSMIDHIPDMIENGVDSLKIEGRMESIHYVLTVTNCYKAAVDAYLESPEKFEAIKQDLVDEMWKVAQRELATGFYYGTPSENEQLFGARRKIPEYKFVAEVVSYDDAAQTATIRQRNVINEGDQVEFYGPGFRHFETYIEDLHDAKGNKIDRAPNPMELLTIKVPQPVQSGDMVRALKEGLINLYKEDGTSVTVRA

SEQ ID NO: 3835 - protein, 65 aa, Streptococcus pneumoniae
  misc_feature (B) LOCATION 1...65
  hypothetical: YES
KMREHEHLQNRNSIKSHLLVPLTFLFLESIYVGSNLFNLTEMIQASTDAGFSASISCFTNFNCSI

SEQ ID NO: 3836 - protein, 126 aa, Streptococcus pneumoniae
  misc_feature (B) LOCATION 1...126
  hypothetical: YES
TKSDSAVFDCFSRRNQIMRYITVEDLSFYYDKEPVLEHINYCVDSGEFVTLTGENGAAKTTLIKASLGILHPRIGKVAISKTNTQGKKLRIAYLPQHIASFNAGFQVRSMNLSSRVAIREMAGSVV

SEQ ID NO: 3837 - protein, 382 aa, Streptococcus pneumoniae
  misc_feature (B) LOCATION 1...382
  hypothetical: YES
QKSEVNAMWMEELPNGKFKYFERYKDPYTEKLKKVSVTMEKKTPQARNQAAILLQEKINKKLSTKQVESITFEEIYNLFYKSWAQTVKESTKHNCKSVDKKMKEVIPSDTILANLDRRFLQEAIEKIIESNGYITAKKVRHRLRGIFNYAVQYSYIENNEVDYTTIPQKPKTLEELEKKRNNFLTMQEIKALVDVLNRREYHQKYADMVLVLTLTGMRYGELTALQLKNIDFENNKIEITGNFDSVNKIKTLPKTTNSIRTIKVSESVIEAIQRQIVRLSERFQPLSSDDYIFCFEKWNQPTTIACFIQILKKYGKQAKIEKNLSSHIFRHSHISFLAESGLPIKSIMDRVGHSNAKMTLEIYSSFTEDMEDKLVNKLDTIF

SEQ ID NO: 3838 - protein, 257 aa, Streptococcus pneumoniae
  misc_feature (B) LOCATION 1...257
  hypothetical: YES
YRSDEMVVYIRQSKLPSEVSINKYNAQVGAYLQGEEAVLYQSFSEIKELTSEDIVVDYIMETRALLKMMGLNVPVHDYPIELKEFYGRKIYAGILGEIVNIPDNWGKFIKPKAGSKVFTGRVVNGTHDLIGIGLPFDYPIWISEVVEFIAEWRCFVLDGRVLDVRPYTGDYHAQFDASVIDEAISCWKDAPIAYGLDIGVTRDGRTLVVEVNDGYALGNYGLSPLKSINFHRARWKEMVKPYFEKNEIFKIQQDVIF

SEQ ID NO: 3839 - protein, 247 aa, Streptococcus pneumoniae
  misc_feature (B) LOCATION 1...247
  hypothetical: YES
DTGDAYIVPHGDHYHYIPKNELSASELAAAEAFLSGRGNLSNSRTYRRQNSDNTSRTNWVPSVSNPGTTNTNTSNNSNTNSQASQSNEDVDSLLKQLYALPLSKRHVESDGLVFDPAQITSRTARGVAVPHGDHYHFIPYSQMSELEERIARIIPLRYRSNHWVPDSRLEQPSLQPTPEPSPGPQPAPNLKIDSNSSLVSQLVRKVGEGYVFEEKGISRYVFAKDLPSETVKNLESKSSKQESVHTL

SEQ ID NO: 3840 - protein, 124 aa, Streptococcus pneumoniae
  misc_feature (B) LOCATION 1...124
  hypothetical: YES
GKGENMAKLIPGKIRIEGVALYETGKVDIIKEKNNRLYARVAEEELRHSLEDDLVFCACDFFQKRGYCVHLAALEHFLKNDERGQEILWSLEEGHEEKEAVETKVHLGWQVFGSNFISKIRMRL

SEQ ID NO: 3841 - protein, 150 aa, Streptococcus pneumoniae
  misc_feature (B) LOCATION 1...150
  hypothetical: YES
NGGDQVIDGKRLLFSLTIVSYALTLVSGVVYLFNNNNVSLLSTLLFLLVSSLIACWNDIKYYLIHFIFYLTIFVFLVSRPTIDYFRDGALDTYHPIAYRFAFIVVMVSILGLTTGGILARYFIARKKIKVANIGNSLKEVYIKRLRFVSL

SEQ ID NO: 3842 - protein, 618 aa, Streptococcus pneumoniae
  misc_feature (B) LOCATION 1...618
  hypothetical: YES
LFCLLPLSVFAIDFKINSYQGDLYIHADNTAEFRQKIVYQFEEDFKGQIVGLGRAGKMPSGFDIDPHPKVQAAKNGAELADVTSEVTEEADGYTVRVYNPGQEGDIVEVDLVWNLKNLLFLYDDIAELNWQPLTDSSESIEKFEFHVRGDKGAEKLFFHTGKLFREGTIEKSNLDYTIRLDNLPAKRGVELHAYWSRTDFASARDQGLKGNRLEEFNKIEDSIVREKDQSKQLVTWVLPSILSISLLLSVCFYFIYRRKTTPSVKYAKNHRLYEPPMELEPMVLSEAVYSTSLEEVSPLVKGAGKFTFDQLIQATLLDVIDRGNVSIISEGDAVGLRLVKEDGLSRFERDCLNLAFSGKKEATLSNLFADYKVSDSLYRRAKVSDEKRIQARGLQLKSSFEEVLNQMQEGVRKRVSFWGLPDYYRPLTGLEKTLQVGMGVLTILPLFIGFGLFLYSLDVHGYLYLPLPILGFLGLVLSVFYYWKLRLDNRDGVLNEAGAEVYYLWTSFENMLREIARLDKAELESIVVWNRLLVYATLFGYADKVSHLMKVHQIQVENPDINLYVAYGWHSMFYHSSAQMSHYASVANTASTYSVSSGSGSSGGGFSGGGGGGSIGAF

SEQ ID NO: 3843 - protein, 71 aa, Streptococcus pneumoniae
  misc_feature (B) LOCATION 1...71
  hypothetical: YES
TKIELYIGEIMNKTTFMAKPGQVERKWYVVDATDVPLGRLSAVVASVLRGKNDPTFTPHTAASFSTSSPHP

SEQ ID NO: 3844 - protein, 158 aa, Streptococcus pneumoniae
  misc_feature (B) LOCATION 1...158
  hypothetical: YES
SFVEMFVGVGASRVRDMFEQAKKHAPCIIFIDEIDAVGRHRGAGLGGGHDEREQTLNQLLVEMDGFEMNDGIIVIAATNRPDVMDPALLRPGRFDRQVVVGLPDIRGREQILKVHMRKVPLGDHVDPAVIARGTPGFSGADGPRSIFKNAKKLKKKGP

SEQ ID NO: 3845 - protein, 99 aa, Streptococcus pneumoniae
  misc_feature (B) LOCATION 1...99
  hypothetical: YES
QYVEDTVTQFKDRDVECTTTKVKYQDFFFFVSLVQTISKSCCSWFVNNTFYFKTSNFTSVFCCLTLSVVEVSRNCDNSFGYFLTKVVFSVAFQVLKDHS

SEQ ID NO: 3846 - protein, 143 aa, Streptococcus pneumoniae
  misc_feature (B) LOCATION 1...143
  hypothetical: YES
KICLLTFRGSKVDMILCNPPYFKVNPYSNLNESEHYLLARHEITTNLEEICRSAQSILKSNGRLAMVHRPDRLLDILDTLKRHNLAPKRLQFVYPKREKEANMLLIEAIKDGSTSGFKVLPPLIVHNDDGSYTPEIEEIYYGS

SEQ ID NO: 3847 - protein, 134 aa, Streptococcus pneumoniae
  misc_feature (B) LOCATION 1...134
  hypothetical: YES
VFADVEKTNESTQSENQSFDKTTFSEESITSETTESQSEASTNKRQEENKTSETSEVAEQTSDSSEAALARAVSADGYSEAATTEELAQLLADESVTKIRLIQPLTLDRELEIKRDIVIDFGGFAHNFGTHHIY

SEQ ID NO: 3848 - protein, 378 aa, Streptococcus pneumoniae
  misc_feature (B) LOCATION 1...378
  hypothetical: YES
EGADLFALRKPGNIYTRITNPTTAALEGGVEALATASGMTAVTYTILALAHAGEHVVAASTIYGGTFNLLKEPLPRYGITTTFVDVDNLEEVEAAIKDNTKLVLIETLGNPLINIPDLEKLAEIAHKHQIPLVSDNTFATPYLINVFSHGVDIAIHSATKFIGGHGTTIGGIIVDSGRFDWTASGKFPQFVDESPSCHNLSYTHDVGAAAFIIAVRVQLRRDTGAALSPFNAFLLLQRLETLSLRVERHVQNAETIVDFLVNHPKVEKVNYPKLADSPYYALAEKYLPKGVGSIFTFHVKGDEEEARKVIDNLEIFSDLANAADAKSLVVHPATITHGQLSEKDLEAAGVTPNQIHLSIGLENVEDLIEDLRLALEKI

SEQ ID NO: 3849 - protein, 650 aa, Streptococcus pneumoniae
  misc_feature (B) LOCATION 1...650
  hypothetical: YES
KTYDYLECLRETCYTTCMIILQANKIERSFAGEVLFDNINLQVDERDRIALVGKNGAGKSTLLKILVGEEEPTSGEINKKKDISLSYLAQDSRFESENTIYDEMLHVFDDLRRTDKQLRQMELEMGEKSGEDLDKLMSDYDRLSENFRQAGGFTYEADIRAILNGFKFDESMWQMKIAELSGGQNTRLALAKMLLEKPNLLVLDEPTNHLDIETISWLENYLVNYSGALIIVSHDRYFLDKVATITLDLTKHSLDRYVGNYSRFVELKEQKLATEAKNYEKQQKEIAALEDFVNRNLVRASTTKRAQSRRKQLEKMERLDKPEAGKKAANMTFQSEKTSGNVVLTVENAAVGYDGEVLSQPINLDLRKMNAVAIVGPNGIGKSTFIKSIVDQIPFIKGEKRFGANVEVGYYDQTQSKLTPSNTVLDELWNDFKLTPEVEIRNRLGAFLFSGDDVKKSVGMLSGGEKARLLLAKLSMENNNFLILDEPTNHLDIDSKEVLENALIDFDGTLLFVSHDRYFINRVATHVLELSENGSTLYLGDYDYYVEKKATAEMSQTEEASTSNQAKEASPVNDYQAQKESQKEVRKLMRQIESLEAEIEELESQSQAISEQMLETNDADKLMELQAELDKISHRQEEAMLEWEELSDQV

SEQ ID NO: 3850 - protein, 119 aa, Streptococcus pneumoniae
  misc_feature (B) LOCATION 1...119
  hypothetical: YES
SNNDLAKCKKYEEFGLDSLLQETRGGRNHAYMTVEEEKAFLARHLKATEAGEFVTIDALFQAYKKELGRSYTRDAFYQLLKHHGWRNIMPRPEHPRKADAQTIVASKNKISIQEGKKAL

SEQ ID NO: 3851 - protein, 221 aa, Streptococcus pneumoniae
  misc_feature (B) LOCATION 1...221
  hypothetical: YES
ACNEQLPDEMTLAKQFACSRMTIKKALDLLVSEGLIFRKRGQGSFVLSRGSSKRKLIVPERDIRGLTKISEDAHSTIDSRIIHFKLEFANEFLAEKLQVALQSPVYNIYRLRIIDGKPYVLEQTYMSTDVIPGITEDILQKSIYNYIEGKLGLHIASATKILRASSSSENEQHYLQLLPTEPVFEVEQVAYLDNGTPFEYSISRHRYDLFEFNSFALRHSS

SEQ ID NO: 3852 - protein, 463 aa, Streptococcus pneumoniae
  misc_feature (B) LOCATION 1...463
  hypothetical: YES
FKNELKIEKDFITMGKYFGTDGVRGEANLELTPELAFKLGRFGGYVLSQHETEAPKVFVGRDTRISGEMLESALVAGLLSVGIHVYKLGVLATPAVAYLVETEGASAGVMISASHNPALDNGIKFFGGDGFKLDDEKEAEIEALLDAEEDTLPRPSAEGLGILVDYPEGLRKYEGYRVSTGTPLDGMKVALDTANGAASTSARQIFADLGAQLTVIGETPDGLNINLNVGSTHPEALQEVVKESGSAIGLAFDGDSDRLIAVDENGDIVDGDKIMYIIGKYLSEKGQLAQNTIVTTVMSNLGFHKALNREGINKAVTAVGDRYVVEEMRKSGYNLGGEQSGHVILMDYNTTGDGQLSAVQLTKIMKETGKSLSELAAEVTIYPQKLVNIRVENVMKEKAMEVPAIKAIIEKMEEEMAGNGRILVRPSGTEPLLRVMAEAPTTEEVDYYVDTITDVVRAEIGID

SEQ ID NO: 3853 - protein, 335 aa, Streptococcus pneumoniae
  misc_feature (B) LOCATION 1...335
  hypothetical: YES
SEDDLIKTDNRTSYTVQYGDTLSTIAEALGVDVTVLANLNKITNMDLIFPETVLTTTVNEAEEVTEVEIQTPQADSSEEVTTATADLTTNQVTVDDQTVQVADLSQPIAEVTKTVIASEEVAPSTGTSVPEEQTTETTRPVEEATPQETTPAEKQETQASPQAASAVEVTTTSSEAKEVASSNGATAAVSTYQPEETKIISTTYEAPAAPDYAGLAVAKSENAGLQPQTAAFKEEIANLFGITSFSGYRPGDSGDHGKGLAIDFMVPERSELGDKIAEYAIQNMASRGISYIIWKQRFYAPFDSKYGPANTWNPMPDRGSVTENHYDHVHVSMNG

SEQ ID NO: 3854 - protein, 65 aa, Streptococcus pneumoniae
  misc_feature (B) LOCATION 1...65
  hypothetical: YES
AQDDQEDLTAIVRDHFSDMGEIATLYVQVYESSLESLLGGVIFEDGRHYTFVYENEDLVYEEEVL

SEQ ID NO: 3855 - protein, 72 aa, Streptococcus pneumoniae
  misc_feature (B) LOCATION 1...72
  hypothetical: YES
RICEICLKQEKQLLLKLLPCWINQEGRVVEIEADYTCFTIPNEFVVGYGLDYKENYRNLPYIGVLKEEVYSN

SEQ ID NO: 3856 - protein, 76 aa, Streptococcus pneumoniae
  misc_feature (B) LOCATION 1...76
  hypothetical: YES
TFCETKIQHNKTMNDEASKQLRDSRFKSLAGVQRTTFEEMLAVLKTTYQRKHAKGGRKTKLSLDDLLMVTIQYMRE

SEQ ID NO: 3857 - protein, 312 aa, Streptococcus pneumoniae
  misc_feature (B) LOCATION 1...312
  hypothetical: YES
SLRETTDYVEVSKNIQERVAFSCGKPAWNYCSDCKCLHSKYQSCRRITVSKITTSLFQEMVQAASTRLNKQAEYVNSLNVFPVPDGDTGTNMGMTIENGAKEVADKPASTVGEVASILAKGLLMGARGNSGVITSQLFRGFSQAIKDKDELTGQDLALAFQSGVEVAYKAVMKPVEGTILTVSRGAAIGAKKKAEQTDDAVEVMRAALEGAKTALAKTPDMLPVLKEVGVVDSGGQGLVFIYEGFLSALTGEYIASEDFVATPANMSEMITVEHHKSVAGHVATEDITFCYCTEIMVALKQGPTYAKDFDYE

SEQ ID NO: 3858 - protein, 550 aa, Streptococcus pneumoniae
  misc_feature (B) LOCATION 1...550
  hypothetical: YES
GESERSKKSFGREQAANLKYQQELVKYIKYTRENNSTKRTEAEKVMTAAKKEHEKKQTELAKVLAKVIPSAEELENTRQKAEKAKEKEPELTKKLEEAKAKSEEAEKKATEAKQKVDAEHAEEVVPQAKIAELENEVQKLEKDLKEIDESDSEDYVKEGLRAPLQSELDAKQAKLSKLEELSDKIDELDAEIAKLEKNVEDFKNSNGEQAEQYRAAAEEDLAAKQAELEKTEADLKKAVNEPEKPAPAPETPAPEAPAEQPKPAPAPQPAPAPKPEKPAEQPKAEKPADQQAEEDYDRRSEEEYNRLTQQQPPKAEKPAPAPQPEQPAPAPKTGWKQENGMWYFYNTDGSMATGWLQNNGSWYYLNSNGAMATGWLQNNGSWYYLNANGAMATGWLQNNGSWYYLNSNGAMATGWLQYNGSWYYLNASGAMATGWAKVNGSWYYLNANGSMATGWLQYNGSWYYLNANGAMATGWAKVNGSWYYLNANGSMATGWVKDGDTWYYLEASGAMKASQWFKVSDKWYYVNGLGALAVNTTVDGYEVNANGEWV

SEQ ID NO: 3859 - protein, 462 aa, Streptococcus pneumoniae
  misc_feature (B) LOCATION 1...462
  hypothetical: YES
RGSDVMAREGFFTGLDIGTSSVKVLVAEQRNGELNVIGVSNAKSKGVKDGIIVDIDTAATAIKSAISQAEEKAGISIKSVNVGLPGNLLQVEPTQGMIPVTSDTKEITDQDVENVVKSALTKSMTPDREVITFIPEEFIVDGFQGIRDPRGMMGVRLEMRGLLYTGPRTILHNLRKTVERAGVQVENVIISPLAMVQSVLNEGEREFGATVIDMGAGQTTVATIRNQELQFTHILQEGGDYVTKDISKVLKTSRKLAEGLKLNYGEAYPPLASKETFQVEVIGEVEAVEVTEAYLSEIISARIKHILEQIKQELDRRRLLDLPGGIVLIGGNAILPGMVELAQEVFGVRVKLYVPNQVGIRNPAFAHVISLSEFAGQLTEVNLLAQGAIKGENDLSHQPISFGGMLQKTAQFVQSTPVQPAPAPEVEPVAPTEPMADFQQASQNKPKLADRFRGLIGSMFDE

SEQ ID NO: 3860 - protein, 70 aa, Streptococcus pneumoniae
  misc_feature (B) LOCATION 1...70
  hypothetical: YES
WVGEKLQSGEYEIRTLFFDVQSHQNPFFKIVKVPETKGFALDNLNQIIGRFKFSVGIRQLKCVDNLISIP

SEQ ID NO: 3861 - protein, 73 aa, Streptococcus pneumoniae
  misc_feature (B) LOCATION 1...73
  hypothetical: YES
FLGDQRSLSRPSVSLVPVNDPTLLWINSGVATLKKYFDGTIIPENPRITNAQKAIRTNDIENVGQDCASPYHV

SEQ ID NO: 3862 - protein, 88 aa, Streptococcus pneumoniae
  misc_feature (B) LOCATION 1...88
  hypothetical: YES
RNSLCLELFWCGSTRVITSAKAEGAEQVILTDHNEFQQSVSDIAEVEVYGVVDHHRVLTLKLQAHFTCVWSQLDQRLQSFTVCSKNMV

SEQ ID NO: 3863 - protein, 173 aa, Streptococcus pneumoniae
  misc_feature (B) LOCATION 1...173
  hypothetical: YES
FSLENIIRRKLRKMAEKTYPMTLEEKEKLEKELEELKLVRRPEVVERIKIARSYGDLSENSEYEAAKDEQAFVEGQISSLETKIRYAEIVNSDAVAQDEVAIGKTVTIQEIGEDEEEVYIIVGSAGADAFAGKVSNESPIGQALIGKKTGDTATIETPVGSYDVKILKVEKTA

SEQ ID NO: 3864 - protein, 171 aa, Streptococcus pneumoniae
  misc_feature (B) LOCATION 1...171
  hypothetical: YES
SMLENGDLIFVRDGSDMGQAIQTSTGNYSHVAIYLDGMIYHASGQAGVVCQEPADFFESNHLYDLYVYPEMDIQSVKERACRHLGAPYNASFYPDAAGFYCSQYIAEILPIFETIPMKFGDGEQEISDFWREYYIELGLPVPLNQAGTNPSQLAASPLLQCKERNLHDSDF

SEQ ID NO: 3865 - protein, 140 aa, Streptococcus pneumoniae
  misc_feature (B) LOCATION 1...140
  hypothetical: YES
KMLENDIKKVLVSHDEITEAAKKLGAQLTKDYAGKNPILVGILKGSIPFMAELVKHIDTHIEMDFMMVSSYHGGTASSGVINIKQDVTQDIKGRHVLFVEDIIDTGQTLKNLRDMFKAREAASVKIATLLDKPRRTCCRN

SEQ ID NO: 3866 - protein, 287 aa, Streptococcus pneumoniae
  misc_feature (B) LOCATION 1...287
  hypothetical: YES
KGLEMILITGANGQLGTELRYLLDERNEEYVAVDVAKMDITNEEMVEKVFEEVKPTLVYHCAAYTAVDAAEDEGKELDFAINVTGTKNVAKASEKHGATLVYISTDYVFDGKKPVGQEWEVDDRPDPQTEYGRTKRMGEELVEKHVSNFYIIRTAWVFGNYGKNFVFTMQNLAKTHKTLTVVNDQYGRPTWTRTLAEFMTYLAENRKEFGYYHLSNDATEDTTWYDFAVEILKDTDVEVKPVDSSQFPAKAKRPLNSTMSLAKAKATGFVIPTWQDALQEFYKQEVR

SEQ ID NO: 3867 - protein, 104 aa, Streptococcus pneumoniae
  misc_feature (B) LOCATION 1...104
  hypothetical: YES
KLLEEGKMKTRKIPLRKSVVSNEVIDKRDLLRIVKNKEGQVFIDPTGKANGRGAYIKLDNAEALEAKKKKVFNRSFSMEVEESFYDELIAYVDHKVKRRELGLE

SEQ ID NO: 3868 - protein, 163 aa, Streptococcus pneumoniae
  misc_feature (B) LOCATION 1...163
  hypothetical: YES
NQLDCNHVVSRDDLNLVYDYLFQKERWESYEITLIGNLYHLFETDYIYMVGKEILERTHYYEKIGKNRNLVVSACLNFWFCCLENSHLIYADYFEMKLQKLLKDDTKVFEKSTFKFVEGYKIYLTESKESGIKQMDNVIKYFEFIESKSIALYFQKRLNELID

SEQ ID NO: 3869 - protein, 363 aa, Streptococcus pneumoniae
  misc_feature (B) LOCATION 1...363
  hypothetical: YES
RKLEVKRMKLNRVVVTGYGVTSPIGNTPEEFWNSLATGKIGIGGITKFDHSDFDVHNAAEIQDFPFDKYFVKKDTNRFDNYSLYALYAAQEAVNHANLDVEALNRDRFGVIVASGIGGIKEIEDQVLRLHEKGPKRVKPMTLPKALPNMASGNVAMRFGANGVCKSINTACSSSNDAIGDAFRSIKFGFQDVMLVGGTEASITPFAIAGFQALTALSTTEDPTRASIPFDKDRNGFVMGEGSGMLVLESLEHAEKRGATILAEVVGYGNTCDAYHMTSPHPEGQGAIKAIKLALEEAEISPEQVAYVNAHGTSTPANEKGESGAIVAVLGKEVPVSSTKSFTGHLLGAAACSRSYRHHRSYAS

SEQ ID NO: 3870 - protein, 84 aa, Streptococcus pneumoniae
  misc_feature (B) LOCATION 1...84
  hypothetical: YES
EGLEIIPYSIFFFFVFHKHFIFGFYNSLTNMEVTNESNPKILGLCQQKATEKFYFISDFIGLIGRNFSLFDSDEVQQNSRKQSL

SEQ ID NO: 3871 - protein, 284 aa, Streptococcus pneumoniae
  misc_feature (B) LOCATION 1...284
  hypothetical: YES
LFIDNMAFGLKLRKYSKEDINKRVQEAAEILGLKEFLERKPADLSGGQRQRVAMGRAIVRDAKVFLMDEPLSNLDAKLRVSMRAEIAKIHRRIGATTIYVTHDQTEAMTLADRIVIMSATKNPAGTGTIGSVEQIGTPQEVYKNPVNKFVAGFIGSPAMNFINVKLVGSEIVSDGFRLKVPEGALKVLREKGYEGKELIFGIRPENVNAEPAFLETFPDCVVKATISVSELLGSESHLYCQVGKDEFVAKVDARDYLQTGATVELGFDLNKAHFFDVETEKTIY

SEQ ID NO: 3872 - protein, 306 aa, Streptococcus pneumoniae
  misc_feature (B) LOCATION 1...306
  hypothetical: YES
PSIERIFMTSKVRKAVIPAAGLGTRFLPATKALAKEMLPIVDKPTIQFIVEEALKSGIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQRVFAREFTGARYDVGDKFGFMKTSIDYALKHPQVKDDLKNYLIQLGKELTEKE

SEQ ID NO: 3873 - protein, 237 aa, Streptococcus pneumoniae
  misc_feature (B) LOCATION 1...237
  hypothetical: YES
SRIDIKDLSFSYSKDSAPVIENLNLTIEPGQRIALVGQSGSGKSTLSKIPSGLYKIDTGKVLFDGVNINQIDKKILSQNLGVVPQDSFLLNRSILDNITLKHEVTSQKIEEVCKAVQIYDEIMAMPMKFNTIISEMGSNISGGQRQRIALARALINNPSIVILDEATSALDTINEKRITKYIQSQGCTQIIIAHRLSTIKDADIIFVMKGGKIVESGNHKYLMTLGGEYYSLYTKRK

SEQ ID NO: 3874 - protein, 105 aa, Streptococcus pneumoniae
  misc_feature (B) LOCATION 1...105
  hypothetical: YES
LAVDFKMIKTYNSRCSVLPPKKLDRKNLTFWGVFIMKLSYDDKVQIYELRKQGYSLEKLSNKFGINNSNLRYMIKLIDRYGIEFGKKGKNRYYSPDLKQEMIHKV

SEQ ID NO: 3875 - protein, 359 aa, Streptococcus pneumoniae
  misc_feature (B) LOCATION 1...359
  hypothetical: YES
IGVEMTKEKNVILTARDIVVEFDVRDKVLTAIRGVSLELVEGEVLALVGESGSGKSVLTKTFTGMLEENGRIAQGSIDYRGQDLTALSSHKEWEQIRGAKIATIFQDPMTSLDPIKTIGSQITEVIVKHQGKTAKEAKELAIDYMNKVGIPDADRRFNEYPFQYSGGMRQRIVIAIALACRPDVLICDEPTTALDVTIQAQIIDLLKSLQNEYHFTTIFITHDLGVVASIADKVAVMYAGEIVEYGTVEEVFYDPRHPYTWSLLSSLPQLADDKGDLYSIPGTPPSLYTDLKGDAFALRSDYAMQIDFEQKAPQFSVSETHWAKTWLLHEDAPKVEKPAVIANLHDKIREKMGFAHLAD

SEQ ID NO: 3876 - protein, 259 aa, Streptococcus pneumoniae
  misc_feature (B) LOCATION 1...259
  hypothetical: YES
TGVEMSIRVIIAGFKGKMGQAACQMVLTDPDLDLVAVLDPFESESEWQGIPVFKDKADLAGFEADVWVDFTTPAVAYENTRFALENGFAPVVGTTGFTSEEIAELKEFSRAQDLGGLIAPNFALGAVLLMQFATQAAKYFPNVEIIELHHDKKKDAPSGTAIKTAELMAEVRESIQQGAADEEELIAGARGADFDGMRIHSVRLPGLVAHQEVIFGNQGEGLTLRHDSYDRISFMTGVNLGIKEVVKRHELVYGLEHLL

SEQ ID NO: 3877 - protein, 574 aa, Streptococcus pneumoniae
  misc_feature (B) LOCATION 1...574
  hypothetical: YES
FGVDVFFTFSGFLITALLIEEFSKNHEIDLIGFFRRRFYRIVPPVVLMVLVTMPFTFLVRQDYVAGIGGQIASVLGFMTNFYELLTGGSYESQFHPHLFVHNWSLAVEVHYYILWGLAVWFLSTHAKSNGQLKGMVFLLSAVAFLISFFSMFIGSFLVTSYSSVYFSSLTHVYPFFLGSMLATIVGVRQTTSLVKQLDKIWDLRKTLVVFGGGFGFLVLLTFFVKFTYLFAYLIGFLLASLAALAMILAARVLHEKTHHIQEPKIISFLADTSYAVYLFHWPFYIIFSQLTSNLLAVLLTLICSYGFASLSFYVLEPWIAGKNTPIVQTLRPLPYIHAILAAGTGILTIIVCTVNLLATQVGAFETDLTVNGLKQAATNIGQTKVMAERADANSLGIADGTMLIGDSVALRANTALQTALPGAQINAQVSVTTKTANEIMLNNSQNKFLPKTVVIATGVNNPENYKDDWDSIVKNLPKGHHMILVTPYEGDKTKETYAIVEKAAAYMRELAEKTPYITIADWNQVAKEHPEIWAGTDQVHFGSESSTIEAGAKLYADTIATALQTAQDKPVKSK

SEQ ID NO: 3878 - protein, 168 aa, Streptococcus pneumoniae
  misc_feature (B) LOCATION 1...168
  hypothetical: YES
PNSEGLIGATIPAFEEKYGIKIELIQAGTGELFKKLESEKEVPVADVIFGGSYTQYATHGELFENYISKENDNVIKEYQNTTGFSTPYTLDGSVLIVHPDLTKGMNIEGYSDLLKPELKGKIATADPANSSSAFAQLTNMLQAQGGYKDDKAWSYVKDLFTLIDGIVK

SEQ ID NO: 3879 - protein, 400 aa, Streptococcus pneumoniae
  misc_feature (B) LOCATION 1...400
  hypothetical: YES
GKSEGAFSSGQAEVIAYYPLQGEKVISSVRELINQDVKDKLESKDNLVFYYTEQEESGLKGVVNRNVTKQIYDLVAFKVEETEKTSLGKVHLTEDGQPFTLDQLFSDASKAKEQLIKELTSFIEDKKIEQDQSEQIVKNFSDQDLSAWNFDYKDSQIILYPSPVVENLEEIALPVSAFFDVIQSSYLLEKDAALYQSYFDKKYQKVVALTFDDGPNPATTPQVLETLAKYDIKATFFVLGKNVSGNEDLVKRIKSEGHVVGNHSWSHPILSQLSLDEAKKQITDTEDVLTKVLGSSSKLMRPPYGAITDDIRNSLDLSFIMWDVDSLDWKSKNEASILTEIQHQVANGSIVLMHDIHSPTVNALPRVIEYLKNQGYTFVTIPEMLNTRLKAHELYYSRDE

SEQ ID NO: 3880 - protein, 349 aa, Streptococcus pneumoniae
  misc_feature (B) LOCATION 1...349
  hypothetical: YES
KMSDSPIKYRLIKKEKHTGARLGEIITPHGTFPTPMFMPVGTQATVKTQSPEELKEMGSGIILSNTYHLWLRPGDELIARAGGLHKFMNWDQPILTDSGGFQVYSLADSRNITEEGVTFKNHLNGSKMFLSPEKAISIQNNLGSDIMMSFDECPQFYQPYDYVKKSIERTSRWAERGLKAHRRPHDQGLFGIVQGAGFEDLRRQSAHDLVSMDFSGYSIGGLAVGETHEEMNAVLDFTTQLLPENKPRYLMGVGAPDSLIDGVIRGVDMFDCVLPTRIARNGTCMTSQGRLVVKNAQFAEDFTPLDPECDCYTCNNYTRAYLRHLLKGDETFGIRLTSYHNLYFLLNLM

SEQ ID NO: 3881 - protein, 148 aa, Streptococcus pneumoniae
  misc_feature (B) LOCATION 1...148
  hypothetical: YES
RWSDWERSSQEIGELIVETILGILSSRGIHLAVQGCEHVNRALVVERQVAEQFGLEIVSVHPTLHAGGSGQLAAFKFMQDPVEVEFIKAHAGLDIGDTAIGMHVKHVQVPIRPILREIGHAHVTALASRPKLIGGARAHYPQDAIRKS

SEQ ID NO: 3882 - protein, 214 aa, Streptococcus pneumoniae
  misc_feature (B) LOCATION 1...214
  hypothetical: YES
DDTESLNWSGDVLIYISLIMKMERLSMVILELYQNDYSKDLVAFDSIEDGKAFVAQIPGYTLETEDGFEVEYFNPKNIPDYMEIIFNGNIVPLSKFMFDPEENVNIIWKEISNLSLKNDRVIEGYSKIDAYVVNNHEVKAYVETRETNYRKAKDFLESRGYEIDRSFFGSEDGEAILYRKKGIEVWHFLCHLDPMFVEIEDVEGYVKEEVGEIQ

SEQ ID NO: 3883 - protein, 88 aa, Streptococcus pneumoniae
  misc_feature (B) LOCATION 1...88
  hypothetical: YES
RDTDMDKQYLHEKLDAMRQNFVESTHHERAVGVLDQAHMSKKMLKIKKKLVALEMERCQRKIEHKDCSKIDQKIKEQKEIFESCCKKD

SEQ ID NO: 3884 - protein, 153 aa, Streptococcus pneumoniae
  misc_feature (B) LOCATION 1...153
  hypothetical: YES
EITDADTRALVAGTMVENPEGFHFDDLQLQTHADNDIEALVSLANMDGEKVEFNATGQGSVQAIFNAIDKFFNQSVRLVSYTINAVTDGIDAQDRVLVTVENRDTETIFNAAGLDFDVLKASAIAYINANTFVQKENAGEMGRSVSYHDMPSV

SEQ ID NO: 3885 - protein, 97 aa, Streptococcus pneumoniae
  misc_feature (B) LOCATION 1...97
  hypothetical: YES
SATDSKEEVESLLSKANQLLEQIHEEGIRQSLAEEVENLKAATNKVDADLDEVNSQVKDVLTRIASALQQEKENAEQDSQTLVLYQKLYDILMSLRK

SEQ ID NO: 3886 - protein, 82 aa, Streptococcus pneumoniae
  misc_feature (B) LOCATION 1...82
  hypothetical: YES
LFADNKHLYKVIKEDFPMTLNEYILQYRLKQAIDKMAESPNSPLSAISDQVGFSDYKYFAKVFKKHLHISPKELKLLGRIVK

SEQ ID NO: 3887 - protein, 453 aa, Streptococcus pneumoniae
  misc_feature (B) LOCATION 1...453
  hypothetical: YES
LIAEAKKRDIRIIMDLVVNHTSDEHAWFVEACENTDSPERDYYIWRDEPNDLDSIFSGSAWEYDEKSGQYYLHFFSKKQPDLNWENEKLRQKIYEMMNFWIDKGIGGFRMDVIDMIGKIPDEKVVNNGPMLHPYLKEMNQATFGDKDLLTVGETWGATPEIAKLYSDPKGQELSMVFQFEHIGLQYQEGQPKWHYQKELNIAKLKEIFNKWQTELGVEDGWNSLFWNNHDLPRIVSIWGNDQEYREKSAKAFAILLHLMRGTPYIYQGEEIGMTNYPFETLDQVEDIESLNYAREALEKGVPIEEIMDSIRVIGRDNARTPMQWDESKNAGFSTGQPWLAVNPNYEMINVQEALANPDSIFYTYQKLVQIRKENSWLVRADFELLDTADKVFAYIRKDGDRRFLVVANLSNDKQNFSVDGKVRSVLIENTAAKEVLEKQVLAPWDAFCVEMTD

SEQ ID NO: 3888 - protein, 775 aa, Streptococcus pneumoniae
  misc_feature (B) LOCATION 1...775
  hypothetical: YES
EYQDRLDQELSVIHDMGFDDYFLVVWDLLRFGRSNGYYMGMGRGSAVGSLVSYALDITGTDPVEKNLIFERFLNRERYTMPDIDIDIPDIYRPDFIRYVGNKYGSKHAAQIVTFSTFGAKQALRDVLKRFGVPEYELSAITKKISFRDNLKSAYEGNLQFRQQINSKLEYQKAFEIACKIEGYPRQTSVHAAGVVISDQDLTNYIPLKYGDEIPLTQYDAHGVEASGLLKMDFLGLRNLTFVQKMQELLAEIEGIHLKIEEIDLEDKETLDLFASGNTKGIFQFEQPGAIRLLKRVQPVCFEDVVATTSLNRPGASDYINNFVARKHGQEEVTVLDPVLEDMLAPTYGIMLYQEQVMQVAQRFAGFSLGKADILRRAMGKKDASAMHEMRASFIQGSLEAGHTVEKAEQVFDVMERFAGYGFNRSHAYAYSALAFQLAYFKTHYPAIFYQIMLNSANSDYLIDALEAGFEVAPLSINTIPYHDKIANKAIYLGLKSIKGVSNDLALWIIEHRPYSNIEDFIAKLPENYLKLPLLEPLVKVGLFDSFEKNRQKVFNNLANLFEFVKELGSLFGDAIYSWQESEDWTEQEKFYMEQELLGIGVSKHPLQAIASKAIYPITPIGNLSENSYAIILVEVQKIKVIRTKKGENMAFLQADDSKKKLDVTLFSDLYRQVGQEIKEGAFYYVKGKIQSRDGRLQMIAQEIREAVAERFWIQVKNHESDQEISRILEQFKGPIPVIIRYEEEQKTIVSPHHFVAKSNELEEKLNEIVMKTIYR

SEQ ID NO: 3889 - protein, 74 aa, Streptococcus pneumoniae
  misc_feature (B) LOCATION 1...74
  hypothetical: YES
PGQEVTFNEVVLVGGENTVVGTPLVAGATVVGTVEKQGKQKKVVTYKYKPKKGSHRKQGHRQPYTKVVINAINA

SEQ ID NO: 3890 - protein, 88 aa, Streptococcus pneumoniae
  misc_feature (B) LOCATION 1...88
  hypothetical: YES
NLQDFTNKLMKLKKEKKMAEFTFEIEEHLLILSENEKGWTKEINRVSFNGAPAKFDIRAWSPDHTKMGKGITLSNEEFQTMVDAFKGN

SEQ ID NO: 3891 - protein, 291 aa, Streptococcus pneumoniae
  misc_feature (B) LOCATION 1...291
  hypothetical: YES
KGQDVTKQAFKEAVFRAIFFMSATVAVVAILLICFFIFSNGLPFMANYGFARFLLGSDWSPTNIPASYGILPMIVGSLLITLGAIVIGVPTGILTSVFMVYYCPKPVYGFLKSAINLMAAIPSIVYGFFGLQLLVPWIRTFLGNGMSVLTASLLLGIMILPTIISLSESAIRTVPKTYYSGSLALGASHERSIFSVILPAARSGILSAVILGIGRAVGETMAVILVAGNQPIIPSGLFSGTRTLTTNIVLEMAYASGQHREALIATSAVLFFLILLINAYFAYLKGKSSYE

SEQ ID NO: 3892 - protein, 394 aa, Streptococcus pneumoniae
  misc_feature (B) LOCATION 1...394
  hypothetical: YES
TVKDVDLKGKKVLVRVDFNVPLKDGVITNDNRITAALPTIKYIIEQGGRAILFSHLGRVKEEADKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPQLAALTEK

SEQ ID NO: 3893 - protein, 786 aa, Streptococcus pneumoniae
  misc_feature (B) LOCATION 1...786
  hypothetical: YES
TFKDKEIKMNKKILETLEFDKVKALFEPHLLTEQGLEQLRQLAPTAKADKIKQAFAEMKEMQALFVEQPHFTILSTKEIAGVCKRLEMGADLNIEEFLLLKRVLLTSRELQSFYANLENVSLEELALWFEKLHDFPQLQGNLQAFNDAGFIENFASEELARIRRKIHDSESQVRDVLQDLLKQKAQMLTEGIVASRNGRQVLPVKNTYRNKIAGVVHDISASGNTVYIEPREVVKLSEEIASLRADERYEMLRILQEISERVRPHAAEIANDAWIIGHLDLIRAKVRFIQERQAVVPQLSENQEIQLLHVCHPLVKNAVANDVYFGQDLTAIVITGPNTGGKTIMLKTLGLTQVMAQSGLPILADKGSRVGIFEEIFADIGDEQSIEQSLSTFSSHMTNIVDILGKVNQHSLLLLDELGAGTDPQEGAALAMAILEDLRLRQIKTMATTHYPELKAYGIETAFVQNASMEFDTATLRPTYRFMQGVPGRSNAFEIAKRLGLSEVIVGDASQQIDQDNDVNRIIEQLEEQTLESRKRLDNIREVEQENLKMNRVLKKLYNELNREKETELNKAREQAAEIVDMALSESDQILKNLHSKSQLKPHEIIEAKAKLKKLAPEKVDLSKNKVLQKAKKKRAPKVGDDIVVLSYGQRGTLTSQLKDGRWEAQVGLIKMTLEEKEFDLVQAQQEKPVKKKQVNVVKRTSGRGPQARLDLRGKRYEEAMNELDAFIDQALLNNMAQVDIIHGIGTGVIREGVTKYLQRNKHVKSFGYAPQNAGGSGATIVTFKG

SEQ ID NO: 3894 - protein, 62 aa, Streptococcus pneumoniae
  misc_feature (B) LOCATION 1...62
  hypothetical: YES
SIKEMHTIDVIGKAPDVTPSQVSKELMVTLGTVTTSLNNLERKGYIERVRSEQDRRVVHLHL

SEQ ID NO: 3895 - protein, 521 aa, Streptococcus pneumoniae
  misc_feature (B) LOCATION 1...521
  hypothetical: YES
RIKERELMNIQEEIKKRRTFAIISHPDAGKTTITEQLLYFGGEIREAGTVKGKKTGTFAKSDWMDIEKQRGISVTSSVMQFDYDGKRVNILDTPGHEDFSEDTYRTLMAVDAAVMVVDSAKGIEAQTKKLFEVVKHRGIPVFTFMNKLDRDGREPLELLQELEEILGIASYPMNWPIGMGKAFEGLYDLYNQRLELYKGDERFASLEDGDKLFGSNPFYEQVKDDIELLNEAGNEFSEEAILAGELTPVFFGSALTNFGVQTFLEIFLKFAPEPHGHKKTDGDIVDPYDKDFSGFVFKIQANMDPRHRDRIAFVRIVSGEFERGMSVNLPRTGKGAKLSNVTQFMAESRENVTNAVAGDIIGVYDTGTYQVGDTLTVGKNKFEFEPLPTFTPEIFMKVSAKNVMKQKSFHKGIEQLVQEGAVQLYKNYQTGEYMLGAVGQLQFEVFKHRMEGEYNAEVVMSPMGKKTVRWIKPEDLDERMSSSRNILAKDRFDQPVFLFENDFALRWFADKYPDVELEEKM

SEQ ID NO: 3896 - protein, 247 aa, Streptococcus pneumoniae
  misc_feature (B) LOCATION 1...247
  hypothetical: YES
LSKEDLSAHNNCIISRWEVLFLDWSIVEQYLPLYQKAFFLTLHIAVWGILGSFLLGLIVSIIRHYRIPVLAQVATAYIELSRNTPLLIQLFFLYFGLPRIGIVLSSEVCATLGLVFLGGSYMAESFRSGLEAISQTQQEIGLAIGLTPLQVFRYVVLPQATAVALPSFSANVIFLIKETSVFSAVALADLMYVAKDLIGLYYETDIALAMLVVAYLIMLLPISLVFSWIERRTRHAGFGNPSTLSRK

SEQ ID NO: 3897 - protein, 76 aa, Streptococcus pneumoniae
  misc_feature (B) LOCATION 1...76
  hypothetical: YES
NIKEKKKNPLFVGILSIILGLLFPIVGLILGIIGLVLAISYQKESQLDYKIEKILNIIGIVISVVNWIVAIALIFR

SEQ ID NO: 3898 - protein, 399 aa, Streptococcus pneumoniae
  misc_feature (B) LOCATION 1...399
  hypothetical: YES
MSKDKKNEDKEILEELKELSEWQKRNQEYLKKKAEEEAALAEEKEKERQARMGEESEKSEDKQDQESETDQEDSESAKEESEEKVASSEADKEKEEKEESESKEKEEQDKKLAKKATKEKPAKAKIPGIHILRAFTILFPSLLLLIVSAYLLSPYATMKDIRVEGTVQTTADDIRQASGIQDSDYTINLLLDKAKYEKQIKSNYWVESAQLVYQFPTKITIKVKEYDIVAYYISGENHYPILSSGQLETSSVSLNSLPETYLSVLFNDSEQIKVFVSELAQISPELKATIQKVELAPSKVTSDLIRLTMNDSDEVLVPLSEMSKKLPYYSKIKPQLSEPSVVDMEAGIYSYTVADKLIMEAEEKAKQEAKEAEKKQEEEQKKQEEESNRNQTTQRSSRR

SEQ ID NO: 3899 - protein, 202 aa, Streptococcus pneumoniae
  misc_feature (B) LOCATION 1...202
  hypothetical: YES
LAKETNFAKFDATVEVAYNLNIDVKKADQQILCGAMVLPNGTGKTSRVLVFARGAKAEEAKAAGADFVGEDDLVAKINDGWLDFDVVIATPDMMALVGRLGRVLGPRNLMPNPKTGTVTMDVAKAVEESKGGKITYRADRAGNVQAIIGKVSFEAEKLVENFKAFNETIQKAKPATAKGTYVTNLTITTTQGVGIKVDVNSL

SEQ ID NO: 3900 - protein, 290 aa, Streptococcus pneumoniae
  misc_feature (B) LOCATION 1...290
  hypothetical: YES
VEKEMELFMKITNYEIYKLKKSGLTNQQILKVLEYGENVDQELLLGDIADISGCRNPAVFMERYFQIDDAHLSKEFQKFPSFSILDDCYPWDLSEIYDAPVLLFYKGNLDLLKFPKVAVVGSRACSKQGAKSVEKVIQGLENELVIVSGLAKGIDTAAHMAALQNGGKTIAVIGTGLDVFYPKANKRLQDYIGNDHLVLSEYGPGEQPLKFHFPARNRIIAGLCRGVIVAEAKMRSGSLITCERAMEEGRDVFAIPGSILDGLSDGCHHLIQEGAKLVTSGQDVLAEFEF

SEQ ID NO: 3901 - protein, 208 aa, Streptococcus pneumoniae
  misc_feature (B) LOCATION 1...208
  hypothetical: YES
KEKEVLQMAIILPELPYAYDALEPYIDAETMHLHHDKHHQTYVNNANAALEKHPEIGEDLEALLADVESIPADIRQALINNGGGHLNHALFWELMTPEKTAPSAELAAAIDATFGSFEEFQAAFTAAATTRFGSGWAWLVVNKEGKLEVTSTANQDTPISEGKKPILGLDVWEHAYYVKYRNVRPDYIKAFFSVINWNKVDELYAAAK

SEQ ID NO: 3902 - protein, 302 aa, Streptococcus pneumoniae
  misc_feature (B) LOCATION 1...302
  hypothetical: YES
NRKDKNTQILVHICKVNITRIYKVYRGRSIMSDRKNMKLFALNSNQEIAQKIAQAVGVPLGKLSSRQFSDGEIQVNIEESVRGYDVYIIQSTSFPVNNHLMELLIMVDACVRASAHSINVVLPYFGYARQDRIACPREPLTAKLVANMLVKAGVDRILTLDLHAVQVQGFFDIPVDNLFTVPLFAKHYCDKGLLGSDVVVVSPKNSGVKRARSLAEYLDAPIAIIDYPQDDATRNEGYIIGDVEGKTAILIDDILNTGRTFSEASKIVEREGATEIYAVSSHGLFVEGAAELLDNTNIKEIL

SEQ ID NO: 3903 - protein, 342 aa, Streptococcus pneumoniae
  misc_feature (B) LOCATION 1...342
  hypothetical: YES
KRKEEIKMKKTWKVFLTLVTALVAVVLVACGQGTASKDNKEAELKKVDFILDWTPNTNHTGLYVAKEKGYFKEAGVDVDLKLPPEESSSDLVINGKAPFAVYFQDYMAKKLEKGAGITAVAAIVEHNTSGIISRKSDNVSSPKDLVGKKYGTWNDPTELAMLKTLVESQGGDFEKVEKVPNNDSNSITPIANGVFDTAWIYYGWDGILAKSQGVDANFMYLKDYVKEFDYYSPVIIANNDYLKDNKEEARKVIQAIKKGYQYAMEHPEEAADILIKNAPELKEKRDFVIESQKYLSKEYASDKEKWGQFDAARWNAFYKWDKENGILKEDLTDKGFTNEFVK

SEQ ID NO: 3904 - protein, 392 aa, Streptococcus pneumoniae
  misc_feature (B) LOCATION 1...392
  hypothetical: YES
FMKDVSLFLLKKVFKSRLNWIILLLFASVLGVTFYLNSQTANSHSLESRLESRIAANERAINENEAKLSQMSDTSSEEYQFAKSNLELQKNLLKRKTEILTLLKEGRWKEAYYLQWQDEEKNYEFVSNDPTASSGLKMGVDRERKIYQALYPLNIKAHTLEFPTHGIDQIIWILEAIIPSLFVVAIIFMLTQLFAERYQNHLDTAHLYPVSKVTFAMSSLGVGVGYVTVLFIGICGFSFLVGSLISGFGQLDYPYPIYSLVKQEVTIGKMQDVLFPSLLLAFLAFIVIVEVVYLIAYFFKQKMPVLFLSLIGIVGLLFGIQTIQPLQKIAHLIPFTYLRSVEILSGRLPKQIDNVDLNWSMGMVLLPCLIIFLLLGILFIERWGSSQKKRIF

SEQ ID NO: 3905 - protein, 634 aa, Streptococcus pneumoniae
  misc_feature (B) LOCATION 1...634
  hypothetical: YES
IMKEERRQFFERIDGNQCRDYILSHCSKDYEKVKSSLERLMDNRFMFDSPWDMEPCSKIHQNQPMVWDQVFEDDPEWAYMLNRQEYLLQFMIGYVVEGDKDYIQKCKFFLFDWIEQVREFSPQSLMTRTLDTGIRSFTWLKLLLLLLKFDLLEEKELEKILVSLEKQIDFMKSYYRAKYTLSNWGILQTIPMLAIYHFFSDKMDLEEAYHFASEELKQQIETQILGDGSQFEQSILYHVEVYKALLDLCLLLPDLQDSYQELLEKMATYIQMMTGLDGRTLAFGDSDSTETTEMLSLSAVVLNKEDLLNGLDVKVDLLSLLFLGREKVKRLQEFERRAWQPKSMIFEDSGHVCIKDEHRYLFFKNGPLGSAHSHSDENSFCLQYQGQPIFIDAGRYSYREIYERYLLKSAWSHSTCIVDGKAPERITGSWEYEYYPHSLFCHHKEREGVHYIEGAYWSAEPDLPYLHKRKILMLVEDVWLLVDDIRCQGQHEALTQFILDKDVTYQDGKINQLRLWSEVDFDLEDTIISPKYNELERSSKLTKRQFFENQMLDYTIIAHESFEIIRHSVYQTDDREVENALAFEVKNDETDKLILLLSEDICVGEKLCLVDGTKMRGKCLVYDKINERMIRLQC

SEQ ID NO: 3906 - protein, 726 aa, Streptococcus pneumoniae
  misc_feature (B) LOCATION 1...726
  hypothetical: YES
MMKDTFKNVLSFEFWQKFGKALMVVIAVMPAAGLMISIGKSIVMINPTFTPLVITGGILEQIGWGVIGNLHILFALAIGGSWAKERAGGAFAAGLAFILINRITGTIFGVSGDMLKNPDAMVTTFFGGSIKVADYFISVLEAPALNMGVFVGIISGFVGATAYNKYYNFRKLPDALSFFNGKRFVPFVVILRSAIAAILLAAFWPVVQTGINNFGIWIANSQETAPILAPFLYGTLERLLLPFGLHHMLTIPMNYTALGGTYDILTGAAKGTQVFGQDPLWLAWVTDLVNLKGTDASQYQHLLDTVHPARFKVGQMIGSFGILMGVIVAIYRNVDADKKHKYKGMMIATALATFLTGVTEPIEYMFMFIATPMYLVYSLVQGAAFAMADVVNLRMHSFGSIEFLTRTPIAISAGIGMDIVNFVWVTVLFAVIMYFIANFMIQKFNYATPGRNGNYETAEGSEETSSEVKVAAGSQAVNIINLLGGRVNIVDVDACMTRLRVTVKDADKVGNAEQWKAEGAMGLVMKGQGVQAIYGPKADILKSDIQDILDSGEIIPETLPSQMTEAQQNTVHFKDLTEEVYSVADGQVVGLEQVKDPVFAQKMMGDGFAVEPANGNIVSPVSGTVSSIFPTKHAFGIVTEAGLEVLVHIGLDTVSLEGKPFTVHVAEGQKVAAGDLLVTADLDAIRAAGRETSTVVVFTNGDAIKSVKLEKTGSLAAKTAVAKVEL

SEQ ID NO: 3907 - protein, 66 aa, Streptococcus pneumoniae
  misc_feature (B) LOCATION 1...66
  hypothetical: YES
KVKEEKKAIVLGADNAYMDKVETTIKSLCVHHYNLKFYVFNDDLPREWFQLMEKRLETLNSEIVNV

SEQ ID NO: 3908 - protein, 249 aa, Streptococcus pneumoniae
  misc_feature (B) LOCATION 1...249
  hypothetical: YES
TRKDFWFCGNRANFIFRRNLNTSFVHAADGIQYVRDDTRDKEEGIEYDDADNGDIIVKVATKPKVVTKKISSTRIRYEKDETKDRSENPVTIDGEDGYVTTTRTYDVNPETGHVTEQVTVDRKEATDTVIKVPAKSKVEEVFVPFATKYEADNDLSAGQEQEITLGKNGKTVTTITYDVDGKSGQVTESTLSQKEDSQTRVVKKGTKPQVLVQEIPIETEYLDGPTLDKSQEVEEVGEIGKLLLLQSIL

SEQ ID NO: 3909 - protein, 175 aa, Streptococcus pneumoniae
  misc_feature (B) LOCATION 1...175
  hypothetical: YES
PRKEVLEGTCSFWYNGRYLKEKRSDMTQIIDGKALAAKLQGQLAEKTAKLKEETGLVPGLVVILVGDNPASQVYVRNKERSALAAGSRSEVVRVPETITQEELLDLIAKYNQDPAWHGILVQLPLPKHIDEEAVLLAIDPEKDVDGFHPLNIDVFWVWTSSHDSLDTCRNYGNVS

SEQ ID NO: 3910 - protein, 85 aa, Streptococcus pneumoniae
  misc_feature (B) LOCATION 1...85
  hypothetical: YES
WVEEKLSSRKDKFCPFFFDVQSDENPFFEVFKVPKTKGIALDVFDEFVSGLKFSVRIRQFNGVSDVVFIANKCAQSGFKGAVEMR

SEQ ID NO: 3911 - protein, 188 aa, Streptococcus pneumoniae
  misc_feature (B) LOCATION 1...188
  hypothetical: YES
AGEDHIMSKKVLFIVGSLRQGSFNHQMALEAEKALAGKAEVSYLDYSALPLFSQDLEVPTHPAVAAAREAVLAADAIWIFSPVYNFSIPGTVKNLLDWLSRALDLSDTRGASALQDKFVTVSSVANAGHDQLFAIYKDLLPFIRTQGVGDFTAARVNDSAWADGKLVLEETVLNSLEKQAQDLIEAIK

SEQ ID NO: 3912 - protein, 73 aa, Streptococcus pneumoniae
  misc_feature (B) LOCATION 1...73
  hypothetical: YES
RIEDRMGKLLTRGFHILFVKRSLYSMKIKEQTRKLAQAAQNSVLRLWIELKKSAQDSVLRLQIELTKSVTYIR

SEQ ID NO: 3913 - protein, 98 aa, Streptococcus pneumoniae
  misc_feature (B) LOCATION 1...98
  hypothetical: YES
QPEEAEAHPQKNIITQSIGQKDEIQPDFGTVILESGDYLLLNSDGLTNMISGSEIRDIVTSDIPLADKTETLVRFANNAGGLDNITVALVSMNEEDEE

SEQ ID NO: 3914 - protein, 315 aa, Streptococcus pneumoniae
  misc_feature (B) LOCATION 1...315
  hypothetical: YES
EGEDMTKLIFMGTPDFSATVLKGLLTDDRYEILAVVTQPDRAVGRKKVIQETPVKQAAKEAGLSIYQPEKLSGSPEMEELMKLGADGIVTAAFGQFLPSKLLDSMDFAVNVHASLLPRHRGGAPIHYALIQGDEEAGVTIMEMVKEMDAGDMIFRRSIPITDEDNVGTLFEKLALVGRDLLLDTLPAYIAGDIKPEPQDTSQVTFSPNIKPEEEKLDWNKTNRQLFNQIRGMNPWPVAHTFLKGDRFKIYEALPVEDQGNPGEILSIGKKELIVATAEGALSLKQVQPAGKPKMDIASFLNGVGRTLTVGERFGD

SEQ ID NO: 3915 - protein, 414 aa, Streptococcus pneumoniae
  misc_feature (B) LOCATION 1...414
  hypothetical: YES
NMEENYNLSITQIKNSIKENSLVLFVGAGISANSNLPTWGELIQSLKKELNIPEERTDSPLRIAQYYYDTFGKNQYTKKIEEIFFKKGLSKPNELHKLIEKIAPKHIITTNYDSLLESQFESGLLKYNVVAEDKDIPYTSSERYLIKMHGDFSKKNIVLKEDDYLDYHLNFPMISTLIQSLIMNHTLLFVGYSLSDSTFNSIFRMIQNTFDLDAKNAYFYTPEEPSMIIREYYKKQGIFIISNEENLGQETSEKQNKLYCRTKDFLEVLSENRSQDVNNADDLWNQLAFLDRLSFIDAKDFSRYSDLKKRALNWDDEYCWFGNDQLRFEIDGHEELRIMVSKKSLLNRFLDMEIGEPRDLKGNRFLSKAFKLYEEKQYSLAKAKFRELANIAFVQKNYFNFLSWGIKFSANSNN

SEQ ID NO: 3916 - protein, 208 aa, Streptococcus pneumoniae
  misc_feature (B) LOCATION 1...208
  hypothetical: YES
KMEELVTLDCLFIDGTKIEANANKYSFVWKKTTEKFSAKLQEQIQVYFQEEITPLLIKYAMFDKEQKRGYKQSARNLANWHYNDKEDSYTHPDGWCYRFHHTKYQKTQTDFQQEIKVYYADEPESAPQKGLYMNERYQNLKAKECQALLSPQGRQIFAQRKIDVEPVFGQIKASLGYKRCNLRGKCQVRIDMGLVLMANNLLKYSEMK

SEQ ID NO: 3917 - protein, 571 aa, Streptococcus pneumoniae
  misc_feature (B) LOCATION 1...571
  hypothetical: YES
RKEDMALEVIMPKAGVDMTEGQIVQWNKKVGEFVKEGEILLEIMTDKVSMELEAEEDGYLIAILKGDGETVPVTEVIGYLGEERENIPTAGAASPEASPVPVASTSNDDGNSDDAFDIVVIGGGPAGYVAAIKAAQLGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVSKINVPGMESPLVMTSDDILEMNEVPESLVIIGGGVVGIELGQAFMTFGSKVTVIEMMDRIVPAMDAEVSKNLRLILERKGMTILTGTKLQEIIEENGQLRIKVEGKDDIIASKALLSIGRMPDLEGIGEVEFELDRGCIKVNEYMETSVPGIYAPGDINGTKMLAHAAFRMGEVAAENALKGNHAVAKLNLTPAAIYTLPEVAAVGLTEEQAREKYDVAIGKFNFAANGRAIASDAAQGFVKVIADKKCGEILGVHIIGPAAAELINEASSIIEMEITVEEMLKTIHGHPTYSEVMYEAFADVLGMAIHSPKKK

SEQ ID NO: 3918 - protein, 238 aa, Streptococcus pneumoniae
  misc_feature (B) LOCATION 1...238
  hypothetical: YES
FCREDTLANGSSAFIVSLLGWMPAPIEISAINSLWSAEKRKTVNFNTEDALFDFNTGYIGTAILAVFFVALGALIQYPTGQAVEAASAKYISQFVGMYASVLGEWSRYLITFIAFLCIFGTVITVIDGYSRVNQESLRLLISQKEDNRKSLNIWMTITAIIGIVIIKFFAGQVSTMLRFAMIGSFLTTPFFALLNYALVTRENKNLPSWLKHLAIAGLIFLFGFAIFFIYALAIGKAG

SEQ ID NO: 3919 - protein, 420 aa, Streptococcus pneumoniae
  misc_feature (B) LOCATION 1...420
  hypothetical: YES
MTRENIKLFSEMHAEPSWLADLRQKAFDKIETLELPVIERVKFHRWNLGDGTITENEPSANVPDFTALDHHLKLVQVGTQTVFEQTPVELAEQGVVFTDFHSALEEIPELIEEFFMSSVKYDDDKLAAYHTAYFNSGAVLYIPDNVEITEPIEGIFYQDSDSNVPFNKHIMIIAGKNSKISYLERLESRGEGSDKVTANITVEVIARSGAQVKFAAIDRLGENVTAYISRRGKLGNDASIDWAIGVMNEGNVVADFDSDLIGNGSHADLKVVALSSGRQVQGIDTRVTNYGCNSIGNILQHGVILEKATLTFNGIGHIIKGAKGADAQQESRVLMLSDQARSDANPILLIDENDVTAGHAASIGQVDPEDMYYLMSRGLDKATAERLVVRGFLGSVIVEIPVKEVRDEMIATIEEKLSKR

SEQ ID NO: 3920 - protein, 235 aa, Streptococcus pneumoniae
  misc_feature (B) LOCATION 1...235
  hypothetical: YES
YNRDKNFYKGKLMKSLRFQSVFDIIGPVMIGPSSSHTAGAVRIGKIVSSIFDDTPTEVEFQLFNSFAKTYRGHGTDLALVAGILGMDTDDPEIPNSLEIAHKRGIKIVWTIQKDSNAPHPNTTKITVKNAHKTISVTGISIGGGNIQVTELNGFAVSLNMNTPTIIIVHQDIPGMIALVTEALSRYGINIAQMNVTREKAGEKAIMIIEVDSRNCDEAIEEIRKIPHLHNVNFFK

SEQ ID NO: 3921 - protein, 338 aa, Streptococcus pneumoniae
  misc_feature (B) LOCATION 1...338
  hypothetical: YES
ECRDAGLLNHVSLTLVFSGEIKMKKYILKKVLFMIPMLLIISFLVFIALDLTPADPLTYMVSPDMASSAEQIEKLRQQLGLNDPVLVRYGRWLWQLLHGDFGYSIVNGNPISKIVGQALPATFELAFVSLIISTIVGIVIGVISAVKQNGIIDNVARFLAVIGTAIPQFFFGILILNFFAIQLRILPIGGRFASGDFTFINRVEHLILPVMAMSIALVAALMRYTRNSMLDVFNADYVKTARAKGVPEWKVYFKHIFRNAMRPILVLLIFRLPMLIGGSVIIESVFSWPGIGSIILSSVTAGDYPVIMITTLMISVVVLFASLLVDIMAAILDPRIRY

SEQ ID NO: 3922 - protein, 329 aa, Streptococcus pneumoniae
  misc_feature (B) LOCATION 1...329
  hypothetical: YES
TKRDYRTFCSGIKIACQSKRCNMKIDVINHLDSPGLAGMICRRINNRILVYGGSYFPNNDPLKSSKVQSNKIRVYDEKFNLLYEQDGKISPDKGITIEVENEIYYILGSSIYRITIGESVEETCIGNFDFQLESGYGCYFDGHLFFGFQESYLFNIETQELFKKSDFPVSGRGQGLSVKYQNELYYLGGANNEAYLDGYKYSLKKDKWEKLEFELPSSVLGASSIQINESGLLILGGFNEIVYNKAVIDLATPGYREEYFSKGRDFFNWNRSMRILDLETGKVKIIANDERFALCGAGFLKTDNGYYVVSGECSPGRRTSDILLLEEEM

SEQ ID NO: 3923 - protein, 335 aa, Streptococcus pneumoniae
  misc_feature (B) LOCATION 1...335
  hypothetical: YES
GERDKMETKTMSFRDTIILAMSEEMRRDENVFLMGEDVGVFGGDFGTSVGMLEEFGPERVRDCPISEAAISGAAAGAAMTGLRPIVDMTFMDFSVIAMDNIVNQAAKTRYMFGGKGQVPMTVRCAAGNGVGSAAQHSQSLESWFTHIPGLKVVAPGTPADMKGLLKSSIRDNNPVIILEYKSEFNQKGEVPVDPDYTIPLGVGEIKRQGTDVTVVTYGKMLRRVVQAAEELAEEGISVEIVDPRTLVPLDKDIIINSVKKTGKVVLVNDAHKTSGYIGEISAIISESEAFDYLDAPIRRCAGEDVPMPYAQNLENAMIPTVESIKDAIRKTYNKE

SEQ ID NO: 3924 - protein, 680 aa, Streptococcus pneumoniae
  misc_feature (B) LOCATION 1...680
  hypothetical: YES
KGREMFDYRALVILMTLMDHCELSLYELSVKVSLPIKEVKEGIDYLVPYLANKGIVLDKKQGRYSLSNRTKQSLTDIIKSDELVLPKSTRLALIYLYTFCRLDFISNNHYQDFLKVSKNTTLSDIQSLRKIMLDNDLELGYSRAKGYTLHGSEWNKHRLAFQMVSELLESSIGIWGLDYVLSSWGYSLTYDLIDQVVKDYYEKLQLVPIVNQLKVYLFGLVFILCRYQRDVERVCLSETLVSPVIQDITTILLDTVVDLGIIDTVFSEDDYRYITVLLSSCFEGEVDVAPVYFNQLTEAIISRMEDISLLHFKQREGLRENLRRHLIPAYYRLKFGLPSSNEYVLHVKEHYPDLFELVKDSLMPLMDAIDNPIPDSETAYFVIHFGGYLKKADTLPQKWYKAAIICPNGVSSSLMLKENLLALFPQIEFIGTSKIDDLQVKASSDYDMVFSTIKVETEKPNYLVSVMMTEEQAIQLVELVLKDFPNLEYGDFEIEQILNIVKRYGIITQELELRLALKNYLYQKNDRKEIVPVLEQLITKETYQVSSQKLGWKEAIRLAAKPLLDQDKITENYPEAMIQKVEEFGPFINLGKGVAIPHARPDEGVNEIGMSMLVLEEPIYLLDNPEQEVRLLICIAAIDNESHLKALSHLTTILRDKNHVQTLISSKNYDDIKMIIKQED

SEQ ID NO: 3925 - protein, 221 aa, Streptococcus pneumoniae
  misc_feature (B) LOCATION 1...221
  hypothetical: YES
KGREMNILVADDEEMIREGIAAFLTEEGYHVIMAKDGQEVLEKFQDLPIHLMVLDLMMPRKSGFEVLKEINQKHDIPVIVLSALGDETTQSQVFDLYADDHVTKPFSLVLLVKRIKALIRRYYVIEDLWRYQDVTVDFTSYKAHYKNEEIDLKPKELLVLKCLIQHKNQVLSREQILEEISKDVADLPCDRVVDVYIRTLRKKLALDCIVTVKNVGYKISL

SEQ ID NO: 3926 - protein, 224 aa, Streptococcus pneumoniae
  misc_feature (B) LOCATION 1...224
  hypothetical: YES
NDGEEAYRAVLEALKAGYRHIDTAAIYQNEESVGQAIKDSGVPREEMFVTTKLWNSQQTYEQTRQALEKSIEKLGLDYLDLYLIHWPNPKPLRENDAWKTRNAEVWRAMEDLYQEGKIRAIGVSNFLPHHLDALLETATIVPAVNQVRLAPGVYQDQFVAYCREKGILLEAWGPFGQGELFDSKQVQEIAANHGKSIAQIALAWSLAEGIFTTSKICHNLSYSS

SEQ ID NO: 3927 - protein, 70 aa, Streptococcus pneumoniae
  misc_feature (B) LOCATION 1...70
  hypothetical: YES
TKGDNHMSLENKLEQATGAVKEGFGKVTGDSKTELEGAVEKTVAKAKDVVEDAKGAVEGAVEGLKNVFTK

SEQ ID NO: 3928 - protein, 213 aa, Streptococcus pneumoniae
  misc_feature (B) LOCATION 1...213
  hypothetical: YES
LKGDTMADRGLLIVFSGPSGVGKGTVRREIFESSENQFQYSVSMTTRAQRPGEVDGVDYFFRTREEFEELIRQGQMLEYAEYVGNYYGTPLTYVNETLDKGIDVFLEIEVQGALQVKKKVPDAVFIFLTPPDLDELQDRLVGRGTDSAEVIVQRIEKAKEEIALMREYDYAIVNDQVPLAAERVKCVIEAEHFCVDRVIGHYQEMLPKSPTTR

SEQ ID NO: 3929 - protein, 69 aa, Streptococcus pneumoniae
  misc_feature (B) LOCATION 1...69
  hypothetical: YES
RKGERKTMEYIYLVTIVGIGLWSLVNKLDDHAEMKQKERQLMANNVARMNLRNSDKQFTYDVEPPEGLK

SEQ ID NO: 3930 - protein, 83 aa, Streptococcus pneumoniae
  misc_feature (B) LOCATION 1...83
  hypothetical: YES
KKGESRYIMAILDDLQALYDNGWDASFNYNGQVCGIFPNSIYDVVVIIADDEYRASSFDDLISLQIEGKTLPEIMNEVEVQYG

SEQ ID NO: 3931 - protein, 191 aa, Streptococcus pneumoniae
  misc_feature (B) LOCATION 1...191
  hypothetical: YES
KEGEFSNMKSITKKIKATLAGVAALFAVFAPSFVSAQESSTYTVKEGDTLSEIAETHNTTVEKLAENNHIDNIHLIYVDQELVIDGPVAPVATPAPATYAAPAAQDETVSAPVAETPVVSETVVSTVSGSEAEAKEWIAQKESGGSYTATNGRYIGRYQLTDSYLNGDYSAENQERVAEPNGHQLEKYHGG

SEQ ID NO: 3932 - protein, 88 aa, Streptococcus pneumoniae
  misc_feature (B) LOCATION 1...88
  hypothetical: YES
MMGDGMKEFQFERKQRFSLRPYAIGACSVLLGTSLFFAGMGAQPVQDTETSSALISSHYLDEQDLSEKLKSELQWLELENKLLNLWEH

SEQ ID NO: 3933 - protein, 361 aa, Streptococcus pneumoniae
  misc_feature (B) LOCATION 1...361
  hypothetical: YES
RKGDSPMKIRIDIPHHPYDIQIEKGCMAQAGQWLRELWQPQKVVIVTDNHVASLYAEKVKLSLEDAGFQVAVFDFLEGEERKNLTTVQKVYEFLVKQGLTRSDGIVALGGGVVGDLAGFVASTYMRGIHFVQIPTSLTAQVDSSIGGKTGVNTPFAKNMVGTFAQPDGVLIDPLVLETLGKRELIEGMGEVIKYGLIEDPELWALLTGLNGSVESILEHAETLIEHSCQVKRKMVVEDELDNGIRLYLNFGHTIGHAIEATAGYGKVMHGEAVAMGMVQISKVAEEKGLMPAGITQSITEMCQKFGLPVDYENWEVDKLYQALTHDKKTRGNTLKLVLVSELGSAIIHPVSLEEMKDYLVK

SEQ ID NO: 3934 - protein, 91 aa, Streptococcus pneumoniae
  misc_feature (B) LOCATION 1...91
  hypothetical: YES
REGEIDKKSTPIFYGEFKNVRLSKEEYKNLKEKLNSHTDIMINKLSRYMESSGKTYQNHYVTILKWYEEDKDKLRQKGLNKKMNYDVGESL

SEQ ID NO: 3935 - protein, 66 aa, Streptococcus pneumoniae
  misc_feature (B) LOCATION 1...66
  hypothetical: YES
IYLEFASSSPFYEATLPLLFFFYYYTLFSCNVNRYHFSTSRLTPGRSPLSEPILSKIPDDEYGGSH

SEQ ID NO: 3936 - protein, 461 aa, Streptococcus pneumoniae
  misc_feature (B) LOCATION 1...461
  hypothetical: YES
MGLELRAIQSPIFSEPFDFTFHAQAFTLLVGSSGSGKSSLFQVIAQVSSLPYSGQVLIDGSEVSQLSIIARVQKVGILFQNPNHQFTMENLFEELIFTLENIGYHLQEIDSKIAEVVQQCRCEAILHRPIHHLSGGEKQKAALAVLFAMNPRVYLLDEPFASIDRKSRIEILEILKELALDGKTVILCDHDLSDYKAYIDHMVELRDGKLREVFQIPSYEMTQVASKEVASSPELFHMNRVTGELGNRPLFSIADFTFYQGISCILGDNGVGKSTLFRSILQFQKYKGRIAWKGTVLKKKKSLYRDLTGVVQEAEKQFIRVSLREELRLDGPDSERNQRIFQALRYFDLEQAVDKSPYQLSGGQQKILQLLTILTSKASVILLDEPFAGLDDRACHYFCKWIVEERNQGRSFLLISHRLDPLISVVDYWIEMTSQGLSHVKEVTITKPLTSQSSNTQGEVR

SEQ ID NO: 3937 - protein, 70 aa, Streptococcus pneumoniae
  misc_feature (B) LOCATION 1...70
  hypothetical: YES
SLLDEMEFRFQLQKKENRRGHKMSKFNRIHLVVLDSVGIGAAPDANNFVNAGVPDGASDTLGHISKTVGF

SEQ ID NO: 3938 - protein, 66 aa, Streptococcus pneumoniae
  misc_feature (B) LOCATION 1...66
  hypothetical: YES
TIMDTVSKKRLKKTDVIAMAGLTTNVMAQMGKDKPITFKNLERICKALSCTPNDIISFEDNFSDEE

SEQ ID NO: 3939 - protein, 323 aa, Streptococcus pneumoniae
  misc_feature (B) LOCATION 1...323
  hypothetical: YES
EIMESKVTIIMQEMLPLLNNEQLLALRESLEHHLVDGKKQQKYSNNNLLQLFITAKQVEGCSSKTIRYYQRTIENLFNAIKESVTQLTTDDLRSYLANYQSEKDCSKANLDNIRRILSSFFAWLEQEEYIIKNPIRRIKKIKTEQNVKETYTDEHLEIMRDNCENLRDLAIIDLLASTGMRVGELVQLNRSDIDFENRECVVFGKGKKERPVYFDARTKIHLRNYLNDRKDSHPALFVTLVGKAQRLGIAGVEIRLRKLGDKLGIQKVHPHKFRRTLATKAIDKGMPIEQVQKLLGHSKIDTTLAYAMVNQNNVKHSHQKFIS

SEQ ID NO: 3940 - protein, 133 aa, Streptococcus pneumoniae
  misc_feature (B) LOCATION 1...133
  hypothetical: YES
QPMDSQDNKRKWKNRDLISSLEFAITGIFTAIKEERNMRKHAVTALVVILAGFGFQVSRIEWLFLLLSIFLVVAFEIINSAIENVVDLASHYHFSMLAKNAKDMAAGAVFVVSLFAALTGALIFLPRIWDLLF

SEQ ID NO: 3941 - protein, 333 aa, Streptococcus pneumoniae
  misc_feature (B) LOCATION 1...333
  hypothetical: YES
VVMDFLLMGALFIVLPRTMVSAKRINQVLDLHSSIQNPAQVQLTDENFKGQVEFKDVTFRYAANSEAVIEHVSFKAETGQTVAFIGSIGSGKSTLVNLIPRFYDVSAGEILVDGVNVQDYDFSATAHAGQRVAIVGPTGAGKTTIVNLLMKFYEIDKGSIRIDGVDTKAMTRSEVHDAFSMVLQDTWLFEGTIRDNLIYNQIGISDERMMEASKAVGIHHFIMTLPDGYDTILDDTVTLSVGQKQLLTIACALLKDASLLILDEATSSVDTRTEELIQKAMDRLMEGRTSFVIAHRLSIIRNADLILVMKDGNIIEQGNYEELMASSPRGSGQ

SEQ ID NO: 3942 - protein, 1243 aa, Streptococcus pneumoniae
  misc_feature (B) LOCATION 1...1243
  hypothetical: YES
ELMDKRIFVEKKADFQVKSESLVRELQHNLGLSSLKSIRIVQVYDVFDLAEDLFAPAEKHIFSEQGTDHVLDEVSVQADLANYAFFAIESLPGQFDQRAASSQEALLLLGSSSDVTVNTAQLYLVNKDIDATELEAVKNYLLNPVDSRFKDITTGIAKQEFSESDKTIPKLTFFESYTAEDFARYKAEQGMAMEVDDLLFIQDYFKSIGRVPTETELKVLDTYWSDHCRHTTFETELKHIDFSASKFQKQLQSTYDKYIAMREELGRSEKPQTLMDMATIFGRYERANGRLDDMEVSDEINACSVEIEVDVDGVKEPWLLMFKNETHNHPTEIEPFGGAATCIGGAIRDPLSGRSYVYQAMRISGAGDITAPISETRAGKLPQQVISKTAAHGYSSYGNQIGLATTYVREYFHPGFVAKRMELGAVVGAAPKGNVVREKPEAGDVIILLGGKTGRDGVGGATGSSKVQTVESVETAGAEVQKGNAIEERKIQRLFRNGNVTRLIKKSNDFGAGGVCVAIGELADGLEIDLNKVPLKYQGLNGTEIAISESQERMAVVVRPEDVDAFVAECNKENIDAVVVATVTEKPNLVMHWNGETIVDLERRFLDTNGVRVVVDAKVVDKDVKLPEERQTSAETLESDTLTVLSDLNHASQKGLQTVFDCSVGRSTVNHPLGGRYQLTPTEASVQKLPVQHGVTHTASVIAQGFNPYVAEWSPYHGAAYAVIEATARLVAAGANWSKARFSYQEYFERMDKQAERFGQPVAALLGSIEAQIQLGLPSIGGKDSMSGTFEELTVPPTLVAFGVTTADSRKVLSPEFKAVGENIYYIPGQALSAEIDFDLIKKNFAQFEASQADHKVTSASAVKYGGVVESLALATFGNYIGAEVTLPELKTALTAQLGGFVFTSPEEIAGVEKIGQTKADFTLTVNGVKLDGHKLDSAFQGTLEEVYPTEFTQAKELEEVPAVASDVVIKAKEKVEKPVVYIPVFPGTNSEYDSAKAFEKEGAEVNLVPFVTLNEEAIVKSVETMVDNIDKTNILFFAGGFSAADEPDGSAKFIVNILLNEKVRVAIDSFIARGGLIIGICNGFQALVKSGLLPYGNFEDANSTSPTLFYNDANQHVAKMVETRIANTNSPWLAGVQVGDIHAIPVSHGEGKFVVTAEEFAELRDNGQIFSQYVDFNGKPSMDSKYNPNGSVHAIEGITSKNGQIIGKMGHSERYEDGLFQNIPGNKDQHLFASAVKHFTGK

SEQ ID NO: 3943 - protein, 415 aa, Streptococcus pneumoniae
  misc_feature (B) LOCATION 1...415
  hypothetical: YES
EMMEFFQQLPHLEPYGNPQYFVYVIAATLPIFIGLFFKKRFAWYEVLVSLFFIVTMLVGGKTNQLAALGIYLCWEILLLLFYKHYRKSKDGKWVFYLVSFLSLLPIIFVKVQPAINGTQSLLGFLGISYLTFRSVGIIIELRDGVIKDFTLWEFLRFLLFMPTFSSGPIDRFKRFNENYQAIPERDELMDMLDESVRYIMRGFLYKFILAHVLGETLLPPLKNLALQSGGFFNLYALAVMYTFGLELFFDFAGYSMFALAISNLMGIRSPINFNKPFLSRDLKEFWNRWHMSLSFWFRDFVFMRMVMVLTRKKVFKNRNVTSSMAYIVNMLIMGFWHGVTWYYIAYGLFHGLGLVINDAWVRKKKTLNKKRKKAGKAALPENRWIQFLGMVVTFHVVMLSFLIFSGFLNNLWFKK

SEQ ID NO: 3944 - protein, 192 aa, Streptococcus pneumoniae
  misc_feature (B) LOCATION 1...192
  hypothetical: YES
LQMEMRLMAFELVDLDRQGTRMKIIFVRHGEPDYRELEERSYIGFGIDLAPLSEMGRQQVQKLSKNPLLSSAEIIVSSAVTRALETASYVVCATGFPLRVEPLLHEWQVYKTGIENFETARRLFLENKGELLPNSPIQYETATEMKSRFLECMSKYREHQTVVVVAHRMLMRQFVPNEKIDFCQVIECELEI

SEQ ID NO: 3945 - protein, 448 aa, Streptococcus pneumoniae
  misc_feature (B) LOCATION 1...448
  hypothetical: YES
VEMEKYLSVTTLTKYLKMKFDKDPYLERVYLTGQVSNFRKRPTHQYFSLKDDHAVIQATIWSGIYQKLGFDLEEGMKINVIGRVQVYEPSGSYSIIIEKAEPDGVGALAIQFEQLKKKLTEEGLFQERFKQALPQFSKRIGVVTSRSGAVIRDIITTVSRRFPGVDILLYPTKVQGEGAAEEIARNIARANQWDDLDLLIIGRGGGSIEDLWAFNEEIVVRAIFESRLPVISSVGHETDVTLADFVADRRAATPTAAAELATPVTKLDVLAHLQNQEKRMVTAVRNVLSKKQEALKKCSQSVIFRQPERLYDGYLQRLDQLQLRLKQSLRTRISDNKQLVQARTHQLVQLSPVTKIQRYQDRLGQLDKLLGSQVALVYDAKVAEVKRLSEALLMLDTSRIVARGYAIVKKEESVVDSVESLKRKDQVTLLMRDGQVELEVKDVKTKEI

SEQ ID NO: 3946 - protein, 363 aa, Streptococcus pneumoniae
  misc_feature (B) LOCATION 1...363
  hypothetical: YES
WLVETWERRRVMSKKLQQISVPLISVFLGILLGAIVMWIFGYDAIWGYEELFYTAFGSLRGIGEIFRAMGPLVLIGLGFAVASRAGFFNVGLPGQALAGWILSGWFALSHPDMPRPLMILATIVIALIAGGIVGAIPGILRAYLGTSEVIVTIMMNYIVLYVGNAFIHAFPKDFMQSTDSTIRVGANATYQTPWLAELTGNSRMNIGIFFAIIAVAVIWFMLKKTTLGFEIRAVGLNPHASEYAGISAKRTIILSMIISGALAGLGGSVEGLGTFQNVYVQGSSLAIGFNGMAVSLLAANSPIGILFAAFLFGVLQVGAPGMNAAQVPSELVSIVTASIIFFVSVHYLIERFVKPKKQVKGGK

SEQ ID NO: 3947 - protein, 129 aa, Streptococcus pneumoniae
  misc_feature (B) LOCATION 1...129
  hypothetical: YES
MKVEPRCDVLSRMSHFFIRILIMELQELVERSWAIRQAYHELEVKHHDSKWTVEEDLLALSNDIGNFQRLVMTKQGRYYDETPYTLEQKLSENIWWLLELSQRLDIDILTEMENFLSDKEKQLNVRTWK

SEQ ID NO: 3948 - protein, 82 aa, Streptococcus pneumoniae
  misc_feature (B) LOCATION 1...82
  hypothetical: YES
LSSLFFDFHCVFKHKNTLKHQGAILTSNIKLLGSGDLLEAQLPKRRSQPSTRSKDFLYQTIPQAQNGDVQASYGKYVYHLSV

SEQ ID NO: 3949 - protein, 107 aa, Streptococcus pneumoniae
  misc_feature (B) LOCATION 1...107
  hypothetical: YES
DSSFAGSLLFSLLSVSLLTLLFIPVMVSSSGSEFQSGWQEHQLIAEKVSKTLDKTFDKDVREIPTSQFYQKFVDQMGRTYSGNLILQELITVNGAYKATYIGELSSN

SEQ ID NO: 3950 - protein, 172 aa, Streptococcus pneumoniae
  misc_feature (B) LOCATION 1...172
  hypothetical: YES
ASTELRFRYFLVKKDWRSTMVQNSCWQSKSHKVKAFTLLESLLALIVISGGLLLFQAMSQLLISEVRYQQQSEQKEWLLFVDQLEAELDRSQFEKVEGNRLYMKQDGKDIAIGKSKSDDFRKTDASGRGYQPMVYGLKSAQITEDNQLVHFRFQFQKGLEREFIYRVEKEES

SEQ ID NO: 3951 - protein, 247 aa, Streptococcus pneumoniae
  misc_feature (B) LOCATION 1...247
  hypothetical: YES
KVTEEFMNVNQIVRIIPTLKANNRKLNETFYIETLGMKALLEESAFLSLGDQTGLEKLVLEEAPSMRTRKVEGRKKLARLIVKVENPLEIEGILSKTDSIHRLYKGQNGYAFEIFSPEDDLILIHAEDDIASLVEVGEKPEFQTDLASISLSKFEISMELHLPTDIESFLESSEIGASLDFIPAQGQDLTVDNTVTWDLSMLKFLVNELDIASLRQKFESTEYFIPKSEKFFLCKDRNNVELWFEEV

SEQ ID NO: 3952 - protein, 61 aa, Streptococcus pneumoniae
  misc_feature (B) LOCATION 1...61
  hypothetical: YES
SGQELTPDLFLLQNDKNHKLFDNYTCQKEKDVLQCKQVKRKEERSYDVGTRVYTISDFLLF

SEQ ID NO: 3953 - protein, 292 aa, Streptococcus pneumoniae
  misc_feature (B) LOCATION 1...292
  hypothetical: YES
TYQELIWSSNMKLAVFTDSSAYLSEETLQREDLFVLDIPVNIDGEEYVEGINLSAEEFYQKMAQASELPKTSQPSIAKLDEILTSLKEQGYTHALGLFLSSGISGFYQNIQYMVDDYEGLTIAFPDTLITSAPLGIMVESVFNWRDQGDDFASIQDKLAIQISRTSAFIMVDDLDHLVKGGRLSNGAAILGNLLSIKPILYFNDQGVIEVYEKVRTEKKATKRLIEIIKETTASGQYRVIVIHGNAPEKAEELRQHLLDFGLGSDVSLATFGSVIGTHLGAGSIALGYIPVI

SEQ ID NO: 3954 - protein, 165 aa, Streptococcus pneumoniae
  misc_feature (B) LOCATION 1...165
  hypothetical: YES
LIQEVFFMGQTIISAIGVYISTSIDYLIILIILFAQLSQNKQKWHIYAGQYLGTGLLVGASLVAAYVVNFVPEEWMVGLLGLIPIYLGIRFAIVGEDAEEEEEEIIERLEQSKANQLFWTVTLLTIASGGDNLGIYIPYFASLDWSQTLVALLVFVIGIIIFCEN

SEQ ID NO: 3955 - protein, 108 aa, Streptococcus pneumoniae
  misc_feature (B) LOCATION 1...108
  hypothetical: YES
SKQDLLYPRKGKALKKQASTNFKPAGQSIEQRPEAINFRLENGHYEIDTVLLTRAKNYCLLVLTDRKSRHQIIRLIPNKSADVVNQALKLILKQPKFFPSHXQKLSCH

SEQ ID NO: 3956 - protein, 83 aa, Streptococcus pneumoniae
  misc_feature (B) LOCATION 1...83
  hypothetical: YES
FYKEIDFIHRKWPDVQKYLVYFQNFTNTREKVEVIRERYEQAINEPGVVGINIGTRPDCLPDETIEYLAELSECMHVTVELGL

SEQ ID NO: 3957 - protein, 67 aa, Streptococcus pneumoniae
  misc_feature (B) LOCATION 1...67
  hypothetical: YES
ENKEHCVSLFLKKTRNFGKMSLMKTFYDVQQFHKRFGINVYMGKRLYDIELMKLELSRIYNARWMDK

SEQ ID NO: 3958 - protein, 177 aa, Streptococcus pneumoniae
  misc_feature (B) LOCATION 1...177
  hypothetical: YES
KLKEKNLMRYITLGQDDKELSEIVLGMMRIKDKSVKEVEELVETALSVGINAFDLADIYGRGRCEELLGLVLKNRPDLREKMWIQSKCGIRIEEFTYFDFPKDYIIKSVDGILQRLKIDHLDSLLLHRPDALMESDQVAEAFDLLYKQGKVRDFGVSNQNPMMMELLKKRCQAAVSC

SEQ ID NO: 3959 - protein, 235 aa, Streptococcus pneumoniae
  misc_feature (B) LOCATION 1...235
  hypothetical: YES
RIKEIRVKAIILAAGLGTRLRPMTENTPKALVQVNQKPLIEYQIEFLKEKGINDIIIIVGYLKEQFDYLKEKYGVRLVFNDKYADYNNFYSLYLVKEELANSYVIDADNYLFKNMFRNDLTRSTYFSVYREDCTNEWFLVYGDDYKVQDIIVDSKAGRILSGVSFWDAPTAEKIVSFIDKAYASGEFVDLYWDNMVKDNIKELDVYVEELEGNSIYEIDSVQDYRKLEEILKNEN

SEQ ID NO: 3960 - protein, 351 aa, Streptococcus pneumoniae
  misc_feature (B) LOCATION 1...351
  hypothetical: YES
CVKEKAMAKKIVALVGDGIGPEIMEAGLEVLEALAEKTGFDYEIDRRPFGGADIDAAGPPLPDETLKASREADAILLAAIGSPQYDGAAVRPEQGLMALRKELNLYANIRPVKIFDSLKYLSPLKPERISGVDFVVVRELTGEIYFGDHILEERKARDINDYSYEEVERIIRKAFEIARNRRKIVTSIDKQNVLATSKLWRKVAEEVAQDFPDVTLEHQLVDSAAMLMITNPAKFDVIVTENLFGDILSDESSVLSGTLEVMPSASHSENGPSLYEPIHGSAPDIAGQGIANPISMILLVVMMLRDSFGRYEDTERIKRAVETSLAAGILTRDIGGQASTKEMMEAIIARL

SEQ ID NO: 3961 - protein, 460 aa, Streptococcus pneumoniae
  misc_feature (B) LOCATION 1...460
  hypothetical: YES
IVKEEKGLKEKQFWNRILEFAQERLTRSMYDFYAIQAELIKVEENVATIFLPRSEMEMVWEKQLKDIIVVAGFEIYDAEITPHYIFTKPQDTTSSQVEEATNLTLYNYSPKLVSIPYSDTGLKEKYTFDNFIQGDGNVWAVSAALAVSEDLALTYNPLFIYGGPGLGKTHLLNAIGNEILKNIPNARVKYIPAESFINDFLDHLRLGEMEKFKKTYRSLDLLLIDDIQSLSGKKVATQEEFFNTFNALHDKQKQIVLTSDRSPKHLEGLEERLVTRFSWGLTQTITPPDFETRIAILQSKTEHLGYNFQSDTLEYLAGQFDSNVRDLEGAINDITLIARVKKIKDITIDIAAEAIRARKQDVSQMLVIPIDKIQTEVGNFYGVSIKEMKGSRRLQNIVLARQVAMYLSRELTDNSLPKIGKEFGGKDHTTVIHAHAKIKSLIDQDDNLRLEIESIKKKIK

SEQ ID NO: 3962 - protein, 251 aa, Streptococcus pneumoniae
  misc_feature (B) LOCATION 1...251
  hypothetical: YES
VVKEQIMTYTILIVEDEYLVRQGLTKLVNVAAYDMEIIGQAENGRQAWELIQKQVPDIILTDINMPHLNGIQLASLVRETYPQVHLVFLTGYDDFDYALSAVKLGVDDYLLKPFSRQDIEEMLGKIKQKLDKEEKEEQLQDLLTNRFEGNMAQKIQSHLADSQFSLKSLASDLGFSPTYLSSLIKKELGLPFQDYLVRERVKQAKLLLLTTDLKIYEIAEKVGFEDMNYFTQRFKQIAGVTPRQFKKGEDR

SEQ ID NO: 3963 - protein, 213 aa, Streptococcus pneumoniae
  misc_feature (B) LOCATION 1...213
  hypothetical: YES
EKKETMIFTYNKEHVGDVLMVIVKNSGDAKLNVERKDKVARVFLKENGETVAWNIFEVSSLFEIAERGQVFLSDEQVARLNQELQAEGFTEEIVNDKEPKFVVGEIVEMVAHPDSDHLNICQVAVASDKIVQIVAGAPNARVGLKTIVALPGAMMPKGNFIFPGELRGEKSFGMMCSPRELHLPNAPQKRGVLELSEDQVVGTPFDPAKHWTA

SEQ ID NO: 3964 - protein, 161 aa, Streptococcus pneumoniae
  misc_feature (B) LOCATION 1...161
  hypothetical: YES
LRKEPSMAKGEGKVVAQNKKARHDYTIVDTLEAGMVLTGTEIKSVRAARINLKDGFAQVKNGEVWLSNVHIAPYEEGNIWNQEPERRRKLLLHKKQIQKLEQETKGTGMTLVPLKVYIKDGYAKLLLGLAKGKHDYDKRESIKRREQNRDIARVMKAVNQR

SEQ ID NO: 3965 - protein, 677 aa, Streptococcus pneumoniae
  misc_feature (B) LOCATION 1...677
  hypothetical: YES
KRKEWSMNLHQPLHVLPGVGPKSAEKYAKLGIENLQDLLLYFPFRYEDFKTKQVLELEDGEKAVLSGQVVTPASVQYYGFKRNRLRFSLKQGEVVFAVNFFNQPYLADKIELGATLAVFGKWDRAKASLNGMKVLAQVEDDLQPVYRLAQGISQASLVKVIKTAFDQGLDLLIEENLPQSLLDKYKLMSRCQAVRAMHFPKDLAEYKQALRRIKFEELFYFQMQLQMLKSENRVQGSGLVLNWSQEKVTAVKVSLPFALTQAQEKSLQEILTDMKSDHHMNRLLQGDVGSGKTVVAGLAMFAAVTAGYQAALMVPTEILAEQHFESLQNLFPNLKLALLTGSLKAAEKREVLETIAKGEADLIIGTHALIQDGVEYARLGLIIIDEQHRFGVGQRRILREKGDNPDVLMMTATPIPRTLAITAFGDMDVSIIDQMPAGRKPIVTRWIKHEQLPQVLTWLEGEIQKGSQAYVISPLIEESEALDLKNAIALSEELTTHFAGKAEVALLHGRMKSDEKDQIMQDFKERKTDILVSTTVIEVGVNVPNATVMIIMDADRFGLSQLHQLRGRVGRGDKQSYAVLVANPKTDSGKDRMRIMTETTNGFVLAEEDLKMRGSGEIFGTRQSGLPEFQVADIIEDFPILEEARKVASYISSIETWQEDPEWRMIALHLEKKEHLD

SEQ ID NO: 3966 - protein, 226 aa, Streptococcus pneumoniae
  misc_feature (B) LOCATION 1...226
  hypothetical: YES
LMKEIFDRRYPVTSFFLLVTTLVFLLMLVTTGGNFDRADTLFRFGAMYGPAIRLFPEQVWRLLSAIFVHIGWEHFIVNMLSLYYLGRQVEEIFGSKQFFFLYLLSGMMGNLFVFVFSPKSLAAGASTSLYGLFAAIIVLRYATRNPYIQQLGQSYLTLFVVNIIGSVLIPGISLAGHIGGAVGGAFLAVIFPVRGEKRMYNTSQRLGAVVLFVGLAILLFYKGMGM

SEQ ID NO: 3967 - protein, 319 aa, Streptococcus pneumoniae
  misc_feature (B) LOCATION 1...319
  hypothetical: YES
TMKENLKVNILWLLLLLAGYSLISVLVSVGVLNLFYVQILQQIGINIILAVGLNLIVGFSGQFSLGHAGFMAIGAYAAAIIGSKSPTYGAFFGAMLVGALLSGAVALLVGIPTLRLKGDYLAVATLGVSEIIRIFIINGGSLTNGAAGILGIPNFTTWQMVYFFVVITTIATLNFLRSPIGRSTLSVREDEIAAESVGVNTTKIKIIAFVFGAITASIAGSLQAGFIGSVVPKDYTFINSINVLIIVVFGGLGSITGAIVSAIVLGILNMLLQDVASVRMIIYALALVLVMIFRPGGLLGTWELSLSRFFKKSKKEEQN

SEQ ID NO: 3968 - protein, 444 aa, Streptococcus pneumoniae
  misc_feature (B) LOCATION 1...444
  hypothetical: YES
NEKEKCQTFILQIGEIMTKTLKRPEVLSPAGTLEKLKVAVQYGADAVFIGGQAYGLRSRAGNFTFEQMEEGVQFAAKYGAKVYVAANMVMHEGNEAGAGEWFRKLRDIGIAAVIVSDPALIMIAATEAPGLEIHLSTQASATNYETLEFWKELGLTRVVLAREVSMEELAEIRKRTDVEIEAFVHGAMCISYSGRCTLSNHMSMRDANRGGCSQSCRWKYDLYDMPFGKERKSLQGEIPEEFSMSAVDMSMIDHIPDMIENGVDSLKIEGRMKSIHYVSTVTNCYKAAVDAYLESPEKFEAIKQDLVDEMWKVAQRELATGFYYGIPSENEQLFGARRKIPEYKFVAEVVSYDDAVQTATIRQRNVINEGDQVEFYGPGFRHFETYIEDLHDAKGNKIDRAPNPMELLTIKVPQPVQSGDMVRALKEGLINFYKEDGTSVTVRA

SEQ ID NO: 3969 - protein, 153 aa, Streptococcus pneumoniae
  misc_feature (B) LOCATION 1...153
  hypothetical: YES
DGEEKMTIRFEEKVSIENAQFVCQWSNSLGKSFQEQWMGPRIPFLLTLQALEGVFSIFDEQEFVGLIQKIRLEDSNLHIGRFFINPQKQEQDLGSQALRKFVSLAFENEDIDSISLNVFEANQRAQNLYQKEGFEIVQMVEAPVRKYSRLKLE

SEQ ID NO: 3970 - protein, 434 aa, Streptococcus pneumoniae
  misc_feature (B) LOCATION 1...434
  hypothetical: YES
NFEDIKMTVKIALLGFGTVASGVPFLLKENGGKINQSAHSDIKVAKVLVKDEDEKNRLLAAGNDFNFVTNVDDILSDQDITIVVELMGRIEPAKTFITRALEAGKHVVTANKDLLAVHGAELLEIAQANKVALYYEAAVAGGIPILRTLANSLASDKITRVLGVVNGTSNFMVTKMVEEGWSYDDALAEAQRLGFAESDPTNDVDGIDAAYKMVILSQFAFGMKIAFDDVAHKGIRNITPEDVAVAQELGYVVKLVGSIEETSSGIAAEVTPTFLPKAHPLASVNGVMNAVFVESIGIGESMYYGPGAGQKPTATSVVADIVRIVRRLNDGTIGKDFNEYSRDLVLANPEDVKANYYFSILAPDSKGQVLKLAEIFNAQDISFKQILQDGKEGDKARVVIITHKINKAQLENVSAELKKVSEFDLLNTFKVLGE

SEQ ID NO: 3971 - protein, 206 aa, Streptococcus pneumoniae
  misc_feature (B) LOCATION 1...206
  hypothetical: YES
EVEEMSQSSYLSPLLWLKKEADKEKMSATQCQIFFFYYQMFELLFARESDMKDLCLGTKGFYFSQLEKNLLSGVSRFLKNLEGKVTLKANQEVSARKALFLALTTSQSDWQELAPVFDFYQTIGRLENPSLLSSQDRQHLMWIYQSALEKDYIVNVIGDKHFVLKRQHATKLTARQTQTLEILSQSEDLVNPVYVTLGEKGVLLLD

SEQ ID NO: 3972 - protein, 158 aa, Streptococcus pneumoniae
  misc_feature (B) LOCATION 1...158
  hypothetical: YES
SKEEIMKKRAIVAVIVLLLIGLDQLVKSYIVQQIPLGEVRSWIPNFVSLTYLQNRGAAFSILQDQQLLFAVITLVVVIGAIWYLHKHMEDSFWMVLGLTLIIAGGLGNFIDRASQGFVVDMFHLDFINFAIFNVADSYLTVGVIILLIAMLKEEINGN

SEQ ID NO: 3973 - protein, 780 aa, Streptococcus pneumoniae
  misc_feature (B) LOCATION 1...780
  hypothetical: YES
KKEDINMVVKTVVEAQDIFDKAWEGFKGVDWKEKASVSRFVQANYTPYDGDESFLAGPTERSLHIKKIVEETKAHYEETRFPMDTRPTSIADIPAGFIDKENEVIFGIQNDELFKLNFMPKGGIRMAETTLKENGYEPDPAVHEIFTKYVTTVNDGIFRAYTSNIRRARHAHTVTGLPDAYSRGRIIGVYARLALYGADYLMQEKVNDWNAIKEIDEETIRLREEVNLQYQALQQVVRLGDLYGVDVRKPAMNVKEAIQWVNIAFMAVCRVINGAATSLGRVPIVLDIFAERDLARGTFTESEIQEFVDDFVMKLRTVKFARTKAYDQLYSGDPTFITTSMAGMGNDGRHRVTKMDYRFLNTLDNIGNSPEPNLTVLWTDKLPYNFRRYCMHMSHKHSSIQYEGVTTMAKDGYGEMSCISCCVSPLDPENEEQRHNIQYFGARVNVLKALLTGLNGGYDDVHKDYKVFDIEPIRDEVLEFESVKANFEKSLDWLTDTYVDALNIIHYMTDRYNYEAVQMAFLPTKQRANMGFGICGFANTVDTLSAIKYATVKPIRDEDGYIYDYETIGDYPRWGEDDPRSNELAEWLIEAYTTRLRSHKLYKDAEATVSLLTITSNVAYSKQTGNSPVHKGVYLNEDGSVNLSKLEFFSPGANPSNKAKGGWLQNLNSLSSLDFSYAADGISLTTQVSPRALGKTRDEQVDNLVTILDGYFENGGQHVNLNVMDLNDVYEKIMSGEDVIVRISGYCVNTKYLTPEQKTELTQRVFHEVLSMDDALDALS

SEQ ID NO: 3974 - protein, 238 aa, Streptococcus pneumoniae
  misc_feature (B) LOCATION 1...238
  hypothetical: YES
KGEDEPMRKFKIFLFIEACLLTGALILMVSEHFSRFLLILFLFLLLIRYYTGKEGNNLLLVAATILFFFIVMLNPFVILAIFVAVIYSLFLLYPMMNQEKEQTNLVFEEVVTVKKEKNRWFGNLHHFSSYQTCQFDDINLFRFMGKDTIHLERVILTNHDNVIILRKMVGTTKIIVPVDVEVSLSVNCLYGDLTFFNQPKRALRNEHYHQETKDYLKSNKSVKIFLTTMIGDVEVVRG

SEQ ID NO: 3975 - protein, 124 aa, Streptococcus pneumoniae
  misc_feature (B) LOCATION 1...124
  hypothetical: YES
LAEERYCTMIIQLSDLGQVHLVCSKIDMRQGIDSLAYVVKTHFELDPFSGQVFLFCGGRKDRFKALYWDGQGFWLLYKRFENGRLTWPSTEKDVKALTPEQVDWLMKGFSITPKINPSESRDFY

SEQ ID NO: 3976 - protein, 72 aa, Streptococcus pneumoniae
  misc_feature (B) LOCATION 1...72
  hypothetical: YES
YKEESMEESKELNAVIDVIMLAGTILLKSGSEIHRVEDTMIRIAIRRGLWIAMSLPCLPLSFSLLKIPIFRA

SEQ ID NO: 3977 - protein, 595 aa, Streptococcus pneumoniae
  misc_feature (B) LOCATION 1...595
  hypothetical: YES
EKEDDLMEEKVSLKVRVQKLGTSLSNMVMPNIGAFIAWGVLTALFIADGYLPNEQLATVVGPMLTYLLPILIGYTGGYMIHGQRGAVVGAIATVGAITGSSVPMFIGAMVMGPLGGWTIKKFDEKFQEKIRPGFEMLVNNFSAGLVGFALLLLAFYAIGPVVSTLTGAVGNGVEAIVNAHLLPMANIIIEPAKVLFLNNALNHGIFTPLGVEQVAQAGKSILFLLEANPGPGLGILLTYAVFGKGSAKSSSWGAMVIHFFGGIHEIYFPYVMMKPTLFLAAMAGGISGTFTFQLLDAGLKSPASPGSIIAIMATAPKGVWPHLNVLLGVLVAAVVSFLVAALILHADKSTEDSLEAAQAATQAAKAQSKGQLVSTSVDAVVSTDSVEKIIFACDAGMGSSAMGASILRDKVKKAGLEIPVSNQAISNLLDTPKTLIVTQEELTPRAKDKSPSAIHVSVDNFLASPRYDEIVASLTGASPIAEIEGDIPTSAPVDSQEIDLNHIDAVVVAYGKAQGTATMGCETIRAIFRNKNIRIPVSTAKISELGEFNSKNIMIVTTISLQAEVQQAAPNSQFLIVDSLVTTPEYDKMAARMYK

SEQ ID NO: 3978 - protein, 111 aa, Streptococcus pneumoniae
  misc_feature (B) LOCATION 1...111
  hypothetical: YES
NEEEFMEIIVPDQIIMGLILYAGDAKQHIYKALDYIKNGTCERCEEEIQLADAALLEAHNLQTKFLAQEASGTKTEITALFVHSQDHLMTSMTEINLIKEIISLRKELHKK

SEQ ID NO: 3979 - protein, 369 aa, Streptococcus pneumoniae
  misc_feature (B) LOCATION 1...369
  hypothetical: YES
SGEEESLTLQAEIIKNTKQPSGMSKLTSFLKMDISQVFRLRRKKLATAKQKNIITLFNNLFSSGFHLVETISFLDRSALLDKQCVTQMRVGLSQGKSFSEMMESLGCSSAIVTQLSLAEVHGNLHLSLGKIEEYLDNLAKVKKKLIEVATYPLILLGFLLLIMLGLRNYLLPQLDSSNIATQIIGNLPQIFLGMVGLVSVLALLALTFYKRSSKMSVFSILARLPFIGIFVQTYLTAYYAREWGNMISQGMELTQIFQMMQEQGSQLFKEVGQDLAQTLKNGREFSQTIGTYPFFRKELSLIIEYGEVKSKLGSELEIYAEKTWEAFFTRVNRTMNLVQPLVFIFVALIIVLLYAAMLMPMYQNMEVNF

SEQ ID NO: 3980 - protein, 273 aa, Streptococcus pneumoniae
  misc_feature (B) LOCATION 1...273
  hypothetical: YES
NFWDHFLVNSLVEIEQFKAGNLDVRMINDINQIQNVVMMTFQILFRLPLLFIGSFILAVQTLPSLWWVIVLMVVLIFGLTAVMMGMMGPRFAKFQTLLERINAIAKENLRGVRVVKSFVQEKEQFAKFTEISDELFGQNLYIGYAFSVVEPFMMLVGYGAVFLSIWLVAGMVQSDPSVVGSIASFVNYLSQIIFTIVMVGFLGNSVSRAMISMRRIREILDAEPAMTFKDIPDEELVGSLSFENVTFTYPMDKEPMLKDVSFTIEPCQMVGVV

SEQ ID NO: 3981 - protein, 293 aa, Streptococcus pneumoniae
  misc_feature (B) LOCATION 1...293
  hypothetical: YES
LSWERKVLRLKTVWTMWEMLTASARFSPEVEQQEEIVVTAYYPDTVDVTVVEADLQARISELTDFMDLGELKIGTTALAEEDWADNWKKYYEPARITHDLTIVPSWTDYEATAGEKIIKLDPGMAFGTGTHPTTKMSLFALEQVLRGGETVLDVGTGSGVLSIASSLLGAKEIFAYDLDDVAVRVAQENIELNPGMENIHVAAGDLLKGVEIEADVIVANILADILIHLTEDAYRLVKDEGYLIMSGIIKDKWDMVRQSAESAGFFLETHMVQGEWNTCVFKKTKDISGVIGG

SEQ ID NO: 3982 - protein, 86 aa, Streptococcus pneumoniae
  misc_feature (B) LOCATION 1...86
  hypothetical: YES
NNRDFKEFDMYNLLLTILLVLSVVIVIAIFMQPTKNQSSNVFDASSGDLFERSKARGFEAVMQRLTGILVFFWLAIALALTVLSSR

SEQ ID NO: 3983 - protein, 105 aa, Streptococcus pneumoniae
  misc_feature (B) LOCATION 1...105
  hypothetical: YES
TIREVVGMVEPNLESLIKDLYNHARHDLSEDLVAALLETTKKLPTTNEQLQAVRLSGLVNRELLLNPKHPAPELLNLARFVKREEAKYRGTATSALMYEELFKML

SEQ ID NO: 3984 - protein, 433 aa, Streptococcus pneumoniae
  misc_feature (B) LOCATION 1...433
  hypothetical: YES
VEREKMYKVLLVDDEYMVTEGLKRLIPFDKWDMEVVATASHADEALEYVQENPVDVIISDVNMPDKTGLDMIREMKEILPDAAYILLSGYQEFDYVKRAMNLSVVDYLVKPVDKVELGNLLEKIAGQLGERGKKSQTLSQELDEAGFVSYLGDKENWWIGLSKEKQGSFTIPYYVLGQDWQIFISGQPLDGLVVTPFEAPYQEHFERWKLNAEKTLFYGSVNLQQSESLFAYYEPIYRVIIQGNLNQIVEELNLLEKVVLENTPRVPITKQLFIQFVMDVFHLFEHLKADDLTDIVKTIHAIQSFDELVSYIKETLISFFGQYRMNENVVSVLEVIGRDYQKELSLKDISKALFINPVYLGQLIKRETDSTFAELLNKQRIKAAQQLLLSTSDSIEDICYAVGYSNLGYFYKVFRKLCGKSPKAYRKQVETIL

SEQ ID NO: 3985 - protein, 322 aa, Streptococcus pneumoniae
  misc_feature (B) LOCATION 1...322
  hypothetical: YES
KRREFMFVARDTRGELVNVLEDKLEKQAYTCPACGGQIHLRQGPSVRTHFAHKSLKDCDFFFENESPEHIANKESLYHWLKKETKVQLEYPLSELKQIADVFVNGNLALEVQCSPLPQKVLKERSEGYRSQGYQVLWLLGQKLWLKERLTRLQQGFLYFSQNMGFYVWELDKEKQVLRLKYLIYQDLRGKLHYQIKEFSYGQGSLLEILRLPYKRQKISHFTVSEDKDICRYIRQQLYYQNLFWMKEQAEAYQKGENILTYGLKEWYPQIRPIVGKFFQIEQDLTSYYRNFYTYYQKNPQNDWQKLYPPAFYQQYFLKNMVE

SEQ ID NO: 3986 - protein, 572 aa, Streptococcus pneumoniae
  misc_feature (B) LOCATION 1...572
  hypothetical: YES
NGRDKMTELDKRHRSSIYDSMVKSPNRAMLRATGMTDKDFETSIVGVISTWAENTPCNIHLHDFGKLAKEGVKSAGAWPVQFGTITVADGIAMGTPGMRFSLTSRDIIADSIEAAMSGHNVDAFVAIGGCDKNMPGSMIAIANMDIPAIFAYGGTIAPGNLDGKDIDLVSVFEGIGKWNHGDMTAEDVKRLECNACPGPGGCGGMYTANTMATAIEVLGMSLPGSSSHPAESADKKEDIEAAGRAVVKMLELGLKPSDILTREAFEDAITVTMALGGSTNATLHLLAIAHAANVDLSLEDFNTIQERVPHLADLKPSGQYVFQDLYEVGGVPAVMKYLLANGFLHGDRITCTGKTVAENLADFADLTPGQKVIMPLENPKRADGPLIILNGNLAPDGAVAKVSGVKVRRHVGPAKVFDSEEDAIQAVLTDEIVDGDVVVVRFVGPKGGPGMPEMLSLSSMIVGKGQGDKVALLTDGRFSGGTYGLVVGHIAPEAQDGGPIAYLRTGDIVTVDQDTKEISMAVSEEELEKRKAETTLPPLYSRGVLGKYAHIVSSASRGAVTDFWNMDKSGKK

SEQ ID NO: 3987 - protein, 85 aa, Streptococcus pneumoniae
  misc_feature (B) LOCATION 1...85
  hypothetical: YES
LRGDIENKTLLIRIIWDNCTRFTTNTLRKSLQTASTSPCRRYVFLTLSVLSTTSKQCFEQPTASFLACSLIFIEYKIQEDNFLKK

SEQ ID NO: 3988 - protein, 242 aa, Streptococcus pneumoniae
  misc_feature (B) LOCATION 1...242
  hypothetical: YES
LKGERYMSNSFVKLLVSQLFANLADIFFRVTIIANIYIISKSVIATSLVPILIGISSFVASLLVPLVTKRLALNRVLSLSQFGKTILLAILVGMFTVMQSVAPLVTYLFVVAISILDGFAAPVSYAIVPRYATDLGKANSALSMTGEAVQLIGWGLGGLLFATIGLLPTTFIILVLYIISSFLMLFLPNAEVEVLESETNLEILLKGWKLVARNPRLRLLYQQIYWKFFQIRFGFLPLYLFL

SEQ ID NO: 3989 - protein, 209 aa, Streptococcus pneumoniae
  misc_feature (B) LOCATION 1...209
  hypothetical: YES
LKSLLQPSPKVSHEPEQVYQVARDGIAKQDHLAYLKPMSYQNTYAVAVPKKIAQEYGLKTISDLKKVEGQLKAGFTLEFNDREDGNKGLQSMYGLNLNVATMQPALRYQAIQSGDIQITDAYSTDAELERYDLQVLEDDKQLFPPYQGAPLMKEALLKKHPELERVLNTLAGKITESQMSQLNYQVGVEGKSAKQVAKEFLQEQGLLKK

SEQ ID NO: 3990 - protein, 234 aa, Streptococcus pneumoniae
  misc_feature (B) LOCATION 1...234
  hypothetical: YES
NSLLLISFILSLIWCLKNMKIMFKNFNNILLKRKIVLLLRIVLMMILINYLLSTAVQKQDAVIFFKRELISIFSYNDYSEANLEIPKLLLNLSLFMVGWLSVILLESDLADHYHHLIRYQSSSFFDYTRKRLVVISKFFTQDLLVWFLGLLPLGIHFKTVALFFLLAQLMMLYLLLSYLIALISAGAGFSFFLYFLAFVGQEWMMDHIVTVYLLLLSLLVMLIVSRLEEKFKKG

SEQ ID NO: 3991 - protein, 114 aa, Streptococcus pneumoniae
  misc_feature (B) LOCATION 1...114
  hypothetical: YES
KYLLEAKKTKIIDWDFADTCWEKELRKYQYVAANYLKAMQSYLKETDLPKLEQLVVTKSWWDTVDILDRVVGSLVYEHPELEEIILILFENLFKPRQLYLQPQNSVLSNLRLAS

SEQ ID NO: 3992 - protein, 187 aa, Streptococcus pneumoniae
  misc_feature (B) LOCATION 1...187
  hypothetical: YES
GGLLKKVKRVRGKGRSPRARKAETVREMVSGGFRLDFLLETARLARSTYYYQLKQLDGVDKDKEIKTEIQAIYNEHKGNYGYRRIHLELRNRGFVVNHKKVQRLMKVLGLTARIRRKRKYSSYQGEIGKKAENLIQRQFEATKPMEKCYTDVTEFAIPNSTQKLYLSPVLDGFNSEISPIIFQLHQT

SEQ ID NO: 3993 - protein, 221 aa, Streptococcus pneumoniae
  misc_feature (B) LOCATION 1...221
  hypothetical: YES
SRSLRCCRPPPCANFETASPLYMRLEPVGSASSIVYRMFKEHGVAVPKEIAGLMLSGLISDTLLLKSPTTHPTDKIIAPELAELAGVNLEEYGLAMLKAGTNLASKSAEELIDIDAKTFELNGNNVRVAQVNTVDIAEVLERQAEIEAAMQAANESNGYSDFVLMITDIVNSNSEILALGANMDKVEAAFNFKLENNHAFLAGAVSRKKQVVPQLTESFNT

SEQ ID NO: 3994 - protein, 62 aa, Streptococcus pneumoniae
  misc_feature (B) LOCATION 1...62
  hypothetical: YES
LLLLLTFYPPLTTQAPLHYIDQPHGKIIARLINDIIHTRIQNIFIFILFLLSLFSTYIVPLI

SEQ ID NO: 3995 - protein, 75 aa, Streptococcus pneumoniae
  misc_feature (B) LOCATION 1...75
  hypothetical: YES
AILLFPNLLFSYVDKISCLSLPPLSPIIVISCLFFPFLMQGKLLSLDDNPKARKVSQTSLLSQTSLQLKGKDSIL

SEQ ID NO: 3996 - protein, 65 aa, Streptococcus pneumoniae
  misc_feature (B) LOCATION 1...65
  hypothetical: YES
VWLLTSSVLSTTSKRCFELTSSVLSTTSKQCFELTSSVLSATSKRCFEQPAASFLVCSLIFIEYY

SEQ ID NO: 3997 - protein, 62 aa, Streptococcus pneumoniae
  misc_feature (B) LOCATION 1...62
  hypothetical: YES
VWLLTSSVSSTTSKPCFELTSSVLSTTSKQCFEQPAASFLVCSLIFIEYKILVFQRFLRSFG

SEQ ID NO: 3998 - protein, 74 aa, Streptococcus pneumoniae
  misc_feature (B) LOCATION 1...74
  hypothetical: YES
VWLLTSSVLSTTSKQCFELTSSVLSTGSKQCFEQSAVSFLVCSLIFIEYKSFNVNEKNFLTKDRDKSKSVDRIK

SEQ ID NO: 3999 - protein, 435 aa, Streptococcus pneumoniae
  misc_feature (B) LOCATION 1...435
  hypothetical: YES
VILLKSTLERTAMPDNLALRMRPKTIDQVIGQEHLVGPGKIIRRMVEANRLSSMILYGPPGIGKTSIASAIAGTTKYAFRTFNATVDSKKRLQEISEEAKFSGGLVLLLDEIHRLDKTKQDFLLPLLESGLVIMIGATTENPFFSVTPAIRSRVQIFELEPLSNQDVKEALQIALSNPERGFDFPIELDEDALDFIATSTNGDLRSAFNSLDLAVLSTPENDEGIRHITLDIMENSLQRSYITMDKDGDGHYDVLSALQKSIRGSDVDASLHYTARLIEAGDLPSLARRLTVIAYEDIGLANPEAQIHTVTALDAAQKIGFPEARILIANVVIDLALSPKSNSAYVAMDKALADLKTSGHLPIPRHLRDGHYSGSKELGNAQDYLYPHNYPGNWVKQDYLPEKIRNHHYFQAEDTGKYERALAQRKEAIDHLRKI

SEQ ID NO: 4000 - protein, 94 aa, Streptococcus pneumoniae
  misc_feature (B) LOCATION 1...94
  hypothetical: YES
SILLKTLDEDILLGCILPWKPEAFEKLKAYGDGREELMTDVRGTSCFVIKFGKAGEQLAAKLWEEGKMVYASYASMTKRLKLAMRARCNGVYGR

SEQ ID NO: 4001 - protein, 451 aa, Streptococcus pneumoniae
  misc_feature (B) LOCATION 1...451
  hypothetical: YES
DQSLTMSEKSQWGSKLGFILASAGSVIGLGSVWKFPYMTAANGGGGFLLIFLISTILIDFPLLLAEFALGRSAGVSAIKTFGKLGKNNKYNFIGWIGAFALFILLSFYSVIGGWILVYLGIEFGKLFQLGGTGDYAQLFTSIISNPAIALGAQATFILLNIFIVSRGVQKGIERASKVMMPLLFIIFVVIIERSLSLPNAMEGVLYFLKPDFSKLTSAGLLYALRQSFFALSLGVTAMLTYASYLDKKTNLVQSRISIVAMNISVSIMAGLAIFQARSPFNIQSEGGPSLVFIVLPQLFDKMPFGTIFYVLFLFATVTSSVVMLEINVDNITNQDNSKRAKWSVILGILTFVFGIPSALSYGVMADVHIFGKAFFDAMDFLVSNLLMPFGALFLSLFTGYIFKKALAMEELHLDERAWKQGLFQVWLFLLRFVIPIIICGLHRPIYVIKRT

SEQ ID NO: 4002 - protein, 126 aa, Streptococcus pneumoniae
  misc_feature (B) LOCATION 1...126
  hypothetical: YES
TESLRKSKMSVLDEEYLKNTRKVYNDFCNQADNYRTSKDFIDNIPIEYLARYREIILAEHDSCVKNDEAVRNFVTSVLLSAFVSAMVSAMISLEIQTYKFVIPFIIGMIWTVVVFLMINWNYIGKY

SEQ ID NO: 4003 - protein, 190 aa, Streptococcus pneumoniae
  misc_feature (B) LOCATION 1...190
  hypothetical: YES
NRSLKMKRPLEMAHDFLAEVVTKEDVVVDATMGNGHDTLFLAKLAKQVYAFDIQKQALEKTQERLHQADLTNAQLILQGHETLDQFVIKAKAGIFNLGYLPSADKSVITRPQTTIEALEKLCGLLVKGGRIAIMIYYGHEGGDLERDAVLDFVIQLNQQEYTAAIYRTLNQVNNPPFLVMIEKLERYRHG

SEQ ID NO: 4004 - protein, 205 aa, Streptococcus pneumoniae
  misc_feature (B) LOCATION 1...205
  hypothetical: YES
VLILFKNLFKPRQLRLAVYMLLTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFELTSSVLSATSKRCFEHHATSFLVCSLIFIEYKNR

SEQ ID NO: 4005 - protein, 468 aa, Streptococcus pneumoniae
  misc_feature (B) LOCATION 1...468
  hypothetical: YES
KGILMSKKRRNRHKKEGQEPQFDFDEAKELTVGQAIRKNEEVEAGVLPEDSILDKYVKQHRDEIEADKFATRQYKKEEFVETQSLDDLIQEMREAVEKSEASSEEVPSSEDILLPLPLDDEEQGLDPLLLDDENPTEMTEEVEEEQNLSRLDQEDSEKKSKKGFILTVLALVSVIICVSAYYVYRQVNRSTKEIETSQSTTANQSDVDDFNTLYDAFYTDSNKTALKNSQFDKLSQLKTLLDKLEGSREHTLAKSKYDSLATQIKAIQDVNAQFEKSAIVDGVLDTHAKAKSDAKFTDIKTGNTELDKVLDKAISLGKSQQTSTFSSSSSQTSSSSSSQASSNTTSEPKPSSSNETRSSRSEVNMGLSSAGVAVQRSASRVAYNQSAIDDSNNSAWDFADGVLEQILATSRSRGYITGDQYILERVNIVNGNGYYNLYKPDVTYLFTLNCKTGYFVGNGAGHADDLDY

SEQ ID NO: 4006 - protein, 255 aa, Streptococcus pneumoniae
  misc_feature (B) LOCATION 1...255
  hypothetical: YES
EPVLATLTIPEGYTLDQIAQTVGQLQGDFKESLTAEAFLAKVQDETFISQAVAKYPTLLESLPVKDSGARYRLEGYLFPATYSIKESTTIESLIDEMLAAMDKNLSPYYSTIKSKNLTVNELLTIASLVEKEGAKTEDRKLIAGVFYNRLNRDMPLQSNIAILYAQGKLGQNISLAEDVAIDTNIDSPYNVYKNVGLMPGPVDSPSLDAIESSINQTKSDNLYFVADVTEGKVYYANNQEDHDRNVAEHVNSKLN

SEQ ID NO: 4007 - protein, 222 aa, Streptococcus pneumoniae
  misc_feature (B) LOCATION 1...222
  hypothetical: YES
QFSLMFEIFKSYQFNQEKAHDYGFIENSEVWTYSCQILQGDFVMTVSITADNVNFQVFDQETGDLYPHVHMESMRGSFVGNVREACLEILYQIRKACFDVQDFICHQTKRIMTQVQEKYGNQLEYLWEKSPDTAVLRHEGNQKWYAVLMKISWNKLEKGREGQVEAVNLKHDQVANLLSQKGIYPAFHMSKRYWISVSLDDTLSDEEVLELIEKSWNLTSKK

SEQ ID NO: 4008 - protein, 198 aa, Streptococcus pneumoniae
  misc_feature (B) LOCATION 1...198
  hypothetical: YES
TVSLPNAKIVLDRFHIVQHLSRAMSRVRVQIMNQFHRKSHEYKAIKHYWKLIQQDSRKLSDKRFYRPTFRMHLTNKEILNKLLSYSEDLKHHYQLYQLLLFHFQNKEPEKFFELIEDNLKQAHPLFQTVFKTFLKDKEKIVNALQLHYSNAKLEATNNLIKLIKRNAFGFRNFENFKKRIFIALNIKKERTKFVLSQA

SEQ ID NO: 4009 - protein, 194 aa, Streptococcus pneumoniae
  misc_feature (B) LOCATION 1...194
  hypothetical: YES
DVGLESRKLAVSGKIKHYVVDNDNVVTPLIHNNRDIVTFTGNSRFKHRSRGYFESPMNDIPNFNIGKQAILDKHGYRDPKLDKVRFFKKQALPRSSSQPSAEPMENIALGKQVTQSSTVFGGDARRAVDGKVDGNYGHNSVTHTNFQSKPWWQVDLAKEETIRQINIYNRTDTAQDRLANFDVILLDSSGKEIE

SEQ ID NO: 4010 - protein, 180 aa, Streptococcus pneumoniae
  misc_feature (B) LOCATION 1...180
  hypothetical: YES
FWSLSGCGNNLSYTKERAEKYLYSLPISNNPLVLVSNKKNPLTSLDQIAGKTTQEDTGTSNAQFINNWNQKHTDNPATINFSGEDIGKRILDLANGEFDFLVFDKVSVQKIIKDRGLDLSVVDLPSADSPSNYIIFSSDQKEFKEQFDKALKELYQDGTLEKLSNTYLGGSYLPDQSQLQ

SEQ ID NO: 4011 - protein, 73 aa, Streptococcus pneumoniae
  misc_feature (B) LOCATION 1...73
  hypothetical: YES
SIPLEGSSKKTNGEFLHITDAIASLCFRPPDKLIGCLSINSSRHKSFKMIFAFSSSKFFTPNLSSLNTSSVNN

SEQ ID NO: 4012 - protein, 125 aa, Streptococcus pneumoniae
  misc_feature (B) LOCATION 1...125
  hypothetical: YES
PLALSQVARGQKNSQVRGKKMAEKMEKTGQILQMQLKRFSRVEKAFYFSIAVTTLIVAISIIFMQTKLLQVQNDLTKINAQIEEKKTELDDAKQEVNELLRAERLKEIANSHDLQLNNENIIIAE

SEQ ID NO: 4013 - protein, 82 aa, Streptococcus pneumoniae
  misc_feature (B) LOCATION 1...82
  hypothetical: YES
VXQXFXXXXLFXEXRLLSKXRITGALPTNKYIIEQGGRAILFSHLGRVKEEADKAGKSLAPVAADLAAKLGQDVVFPGVTRG

SEQ ID NO: 4014 - protein, 194 aa, Streptococcus pneumoniae
  misc_feature (B) LOCATION 1...194
  hypothetical: YES
ELGLHQAQTVKENNRVSYIDGKHATQKTENLTPDEVSKREGINAEQIVIKITDQGYVTSHGDHYHYYNGKVPYDAIISEELLMKDPNYQLKDSDIVNEIKGGYVIKVNGKYYVYLKDAAHADNVRTKEEINRQKQEHSQHREGGTSANDGAVAFARSQGRYTTDDGYIFNASDIIEDTGRCLYRSSWRSLPLHS

SEQ ID NO: 4015 - protein, 507 aa, Streptococcus pneumoniae
  misc_feature (B) LOCATION 1...507
  hypothetical: YES
KRQLLYQGASYPRRWRRCLMTFNNKTIEELHNLLVSKEISATELTQATLENIKSREEALNSFVTIAEEQALVQAKAIDEAGIDADNVLSGIPLAVKDNISTDGILTTAASKMLYNYEPIFDATAVANAKTKGMIVVGKTNMDEFAMGGSGETSYYGATKNAWDHSKVPGGSSSGSAAAVASGQVRLSLGSDTGGSIRQPAAFNGIVGLKPTYGTVSRFGLIAFGSSLDQIGSFAPTVKENALLLNAIASEDAKDSTSAPVRIADFTSKIGQDIKGMKIALPKEYLGEGINPEVKETILNAAKHFEKLGAIVEEVSLPHSKYGVAVYYIIASSEASSNLQRFDGIRYGYRAEDATNLDEIYVNSRSQGFGEEVKRRIMLGTFSLSSGYYDAYYKKAGQVRTLIIQDFEKVFADYDLILGPTAPSVAYDLDSLNHDPVAMYLADLLTIPVNLAGLPGISIPAGFSQGLPVGLQLIGPKYSEETIYQAAAAFEATTDYHKQQPVIFGGDN

SEQ ID NO: 4016 - protein, 264 aa, Streptococcus pneumoniae
  misc_feature (B) LOCATION 1...264
  hypothetical: YES
DFKLSRYDDRRSFPLGGAVAVTLITKGVNPFLATLVAVGAGCLAGMAAGLLYTKGKIPTLLSGILVMTSRHSIMLLIMGRANLGLLGTKQIQDVLPFDSDLNQLLTGLIFVSIVIALMLFFLDTKLGQAYIATGDNPDMARSFGIHTGRMELMGLVLSNGVIALAGALIAQQEGYADVSRGIGVIVVGLASLIIGEVIFKSLSLAERLVTIVVGSIAYQFLVWAVIALGFNTSYLRLYSALILAVCLMIPTFKQTILKGAKLSK

SEQ ID NO: 4017 - protein, 406 aa, Streptococcus pneumoniae
  misc_feature (B) LOCATION 1...406
  hypothetical: YES
LSKLVDVVMIQSLFKLENSQSLLDEYEMMIVDECHHISALMFEKVVAQLRGKYLYGLTATPERKNGHEPIVFQRIGEILHTADKRETDFKRQLQLRFTSFGHLEIEKTKASNFIQLSDWIATDSARNQLILKDILAQVAEGRNILGLVNRIQQIDVFEKLLKEKEVDDCYIISGKTKVRERTSLLETLEQLDKGFVLLSTGKYIGEDFDLPQLDTLILAAPFSWKNNLIQYAGRIHRNYKDKSLVRIFDYVDIHVPYLEKMFQKRQVAYRKMDYRVIEGEEKQFVYVDSRYEKVLREDLAGERQECLLILPYVHQTKLMNFLKEFRISQIEICIPETVANKAWLDQLKSQKIKVSFTQSKIVTPILLVNKTIVWYGAMPLLGKVDEMTILRLESASIVSELVAGLR

SEQ ID NO: 4018 - protein, 305 aa, Streptococcus pneumoniae
  misc_feature (B) LOCATION 1...305
  hypothetical: YES
MDKLEQVKSCVISLCHQHLFKQMVKTLAIWSKRNWSLMGMNGRMLILQILRMVFTIQKKARLRFAKAKSALQAEGVQFPIHLDMPVDQTATTKVQRVQSMKQSLEATLGADNVIIDIQQLQKDEVNNITYFAENAAGEDWDLSDNVGWGPDFADPSTYLDIIKPSVGESTKTYLGFDSGEDNVAAKKVGLYDYEKLVTEAGDETTDVAKRYDKYAAAQAWLTDSALIIPTTSRTGRPILSKMVPFTIPFALSGNKGTSEPVLYKYLELQDKAVTVDEYQKAQEKWMKEKEESNKKAQEDLAKHVK

SEQ ID NO: 4019 - protein, 299 aa, Streptococcus pneumoniae
  misc_feature (B) LOCATION 1...299
  hypothetical: YES
GFFCYNICMQFTFTLPASLPQMTVKQLLEEQLLIPRKIRHFLRIKKHILINQEEVHWNEIVNPGDVCQLTFDEEDYSQKTIPWGNPDLVQEVYQDQHLIIVNKPEGMKTHGNQPNEIALLNHVSTYVGQTCYVVHRLDMETSGLVLFAKNPFILPILNRLLEKKEISREYWALVDGNINRKELVFRDKIGRDRHDRRKRIVDAKNGQYAETYVSRLKQFSNKTSLAHCKLKTGRTHQIRVHLSHHNFPILGDPLYNSNSKTSRLMLHAFRLSFTHPLTLEKLNFTALSNTFETELKKNG

SEQ ID NO: 4020 - protein, 226 aa, Streptococcus pneumoniae
  misc_feature (B) LOCATION 1...226
  hypothetical: YES
PVFWYNKKNKLKEGIPKMGKIEVINHPLIQHKLSILRRTDTSTKAFRELVDEIAMLMGYEVLRDLPLEDVEIETPITKTVQKQLAGKKLAIVPILRAGIGMVDGLLSLVPAAKVGHIGMYRDEETLQPVEYLVKLPEDIDQRQIFVVDPMLATGGSAILAVDSLKKRGASNIKFVCLVSAPEGVKALQEAHPDVEIFTAALDERLNEHGYIVPGLGDAGDRLFGTK

SEQ ID NO: 4021 - protein, 114 aa, Streptococcus pneumoniae
  misc_feature (B) LOCATION 1...114
  hypothetical: YES
YRKLVRGLEEEPEGGDRCKVCFDYRLDKTAQVAMDLGFDYFGSALTISPHKNSQTINSIGIDVQKIYTPHYFPNDFKKNQGYKRSVEMCEEYDIYRQCYCGCVYAAQAQNIDLV

SEQ ID NO: 4022 - protein, 95 aa, Streptococcus pneumoniae
  misc_feature (B) LOCATION 1...95
  hypothetical: YES
ICFCNCNTVRCCDSFKHFCHFPYANPSFSIVSEIAAIASSASAPSAEIVTSAPWPTPRLITPIIDLRLTDLPLYSRVISEANLLAVCTNNVAGRA

SEQ ID NO: 4023 - protein, 104 aa, Streptococcus pneumoniae
  misc_feature (B) LOCATION 1...104
  hypothetical: YES
NSFWIRCCSMTIHLSSLGQVYLVCGKTDMRQGIDSLAYLVKTHFELDPFSGQVFLFCGGRKDRFKALYWDGQGFWLLYKRFENGRLTWLSTEKDVKALAPEQVD

SEQ ID NO: 4024 - protein, 328 aa, Streptococcus pneumoniae
  misc_feature (B) LOCATION 1...328
  hypothetical: YES
RRKLMEVFESLKANLVGKNARIVLPEGEEPRILQATKRLVKETEVIPVLLGNPEKIKIYLEIEGIMDGYEVIDPQHYPQFEEMVSALVERRKGKMTEEDVRKVLVEDVNYFGVMLVYLGLVDGMVSGAIHSTASTVRPALQIIKTRPNVTRTSGAFLMVRGTERYLFGDCAININPDAEALAEIAINSAITAKMFGIEPKIAMLSYSTKGSGFGESVDKVVEATKIAHDLRPDLEIDGELQFDAAFVPETAALKAPGSTVAGQANVFIFPGIEAGNIGYKMAERMGGFAAVGPVLQGLNKPVNDLSRGCNADDVYKLTLITAAQAVHQ

SEQ ID NO: 4025 - protein, 162 aa, Streptococcus pneumoniae
  misc_feature (B) LOCATION 1...162
  hypothetical: YES
KGKLMVLDYFFDKNLVFCLEADNQEQLFDQVATLLEEREIVTPTYREALITREKSFPTGLDMEFLGKDLPNVAIPHTDIVHNLAEKVVVVRLEKPVTFHNMIAPDKEVEVSLLFFIINNSSSSQTNILAQLMDFFTGNGHLEDLSKISEPEKLYAYIAEATA

SEQ ID NO: 4026 - protein, 301 aa, Streptococcus pneumoniae
  misc_feature (B) LOCATION 1...301
  hypothetical: YES
GMKLLVVGSGGREHAIAKKLLESKDVEKVFVAPGNDGMTLDGLELVNISISEHSKLIDFAKTNDVAWTFIGPDDALAAGIVDDFNQAGLKAFGPTRAAAELEWSKDFAKEIMVKYGVPTAIYGTFSDFEEAKAYIEKHGAPIVVKADGLALGKGVVVAETVEQAVEAAHEMLLDNKFGDSGARVVIEEFLEGEEFSLFAFVNGDKFYIMPTAQDHKRAYDGDKGPNTGGMGAYAPVPHLPQSVVDTAVDTIVKPVLEGVIKEGRPYLGVLYAGLILTADGPKSSSSTLGSEIQKLSLSCLA

SEQ ID NO: 4027 - protein, 211 aa, Streptococcus pneumoniae
  misc_feature (B) LOCATION 1...211
  hypothetical: YES
TMKLEIINGQKIYGKRPILNQLNLVFQSGKIYGLKGDNGSGKTVLLKVLAGYIKLDKGKVLQDGKVYGIKNHYIQDAGILIEKVEFLSHLSLRENLELLRYFSSKVTEKRIAYWIQYYDLQEFEDVEYRHLSLGTKQKMALIQAFISSPSILFLDEPMNALDEKSVRLTKQVILSYLKKENGLVILTSHISEDISDLCTDVLVVENGHIQM

SEQ ID NO: 4028 - protein, 461 aa, Streptococcus pneumoniae
  misc_feature (B) LOCATION 1...461
  hypothetical: YES
QRLWSVLKQGKFWQQRNDPTFDADTKEGITEDFVWRDILYQSNYEPGSTMKVMMLAAAIDNNTFPGGEVFNSSELKIADATIRDWDVNEGLTGGRMMTFSQGFAHSSNVGMTLLEQKMGDATWLDYLNRFKFGVPTRFGLTDEYAGQLPADNIVNIAQSSFGQGISVTQTQMIRAFTAIANDGVMLEPKFISAIYDPNDQTARKSQKEIVGNPVSKDAASLTRTNMVLVGTDPVYGTMYNHSTGKPTVTVPGQNVALKSGTAQIADEKNGGYLVGVTDYIFSAVSMSPAENPDFILYVTVQQPEHYSGIQLGEFANPILERASAMKDSLNLQTTAKALEQVSQQSPYPMPSVKDISPGDLAEELRRNLVQPIVVGTGTKIKNSSAEEGKNLAPNQQVLILSDKVEEVPDMYGWTKETAETLAKWLNIELEFQGSGSTVQKQDVRANTAIKDIKKITLTLGD

SEQ ID NO: 4029 - protein, 533 aa, Streptococcus pneumoniae
  misc_feature (B) LOCATION 1...533
  hypothetical: YES
HRLWALLGKVELFVMHYEHSRKGNHMIKINHLTITQNKDLRDLVSDLTMTIQDGEKVAIIGEEGNGKSTLLKILMGEALSDFTIKGNIQSDYQSLAYIPQKLPEELKKKTLHDYFFLDSIDLDYSILYRLAEELHFDSNRFASDQEIGSLSGGEALKIQLIHELAKPFEILFLDEPSNDLDLETVDWLKGQIQKTRQTVIFISHDEDFLSETADTIVHLRLVKHRKEAETLVEHLDYDSYSEQRKANFAKQSQQAANNQRAYDKTMEKHRRVKQNVETALRATKDSTAGRLLAKKMKTVLSQEKRYEKTAQSMTQKPLEEEQIQLFFSDIQPLPASKVLVQLEKENLSIDDRVLVQKLQLTVRGQEKIGIIGPNGVGKSTLLAKLKQLLNDKREISLGFMPQDYHKKLQLDLSPIAYISKTGEKEELQKIHSHLASLNFSYPEMQHQIRSLSGGQQGKLLLLDLVLRKPNFLLLDEPTRNFSPTSQPQIKKLFATYPGGLITVSHDRRFLKEVCSIIYRMTEHGLELVNLEDL

SEQ ID NO: 4030 - protein, 215 aa, Streptococcus pneumoniae
  misc_feature (B) LOCATION 1...215
  hypothetical: YES
KEKLMREHRPIIALDFPSFEAVKEFLALFPAEESLYLKVGMELYYAAGPEIVSYLKGLGHSVFLDLKLHDIPNTVKSAMKVLSQLGVDMTNVHAAGGVEMMKAAREGLGSQAKLIAVTQLTSTSEAQMQEFQNIQTSLQESVIYYAKKTAEAGLDGVVCSAQEVQVIKQATNPDFICLTPGIRPAGAAVGDQKRVMTPADAYQIGSDFFTTEVWA

SEQ ID NO: 4031 - protein, 249 aa, Streptococcus pneumoniae
  misc_feature (B) LOCATION 1...249
  hypothetical: YES
RDIWFEMKSIIDVKNLSFRYKENQNYYDVKDITFHVKRGEWLSIVGHNGSGKSTTVRLIDGLLEAESGEIVIDGQRLTEENVWNIRRQIGMVFQNPDNQFVGATVEDDVAFGLENQGLSRQEMKKRVEEALALVGMLDFKKREPARLSGGQKQRVAIAGVVALRPAILILDEATSMLDPEGRRELIGTVKGIRKDYDMTVISITHDLEEIAMSDRLLVLRKREIESTSSPRELFSRNDLDTNWIRRSFC

SEQ ID NO: 4032 - protein, 61 aa, Streptococcus pneumoniae
  misc_feature (B) LOCATION 1...61
  hypothetical: YES
QAICYVDPIGEQSNPLGYNALKSYYPFSDSLNSSILTGNRLNDTPLSANRLQKAVILGTPN

SEQ ID NO: 4033 - protein, 155 aa, Streptococcus pneumoniae
  misc_feature (B) LOCATION 1...155
  hypothetical: YES
WLVCQRGGFGMIPKFRVWVKIGKRMVFSDDILAIDYENKEIVTQQVYFENGLPDDRDIYCYDFDEIELMQSTGLKDKNGKEIFEGDIVRTTRFLGRADEIGGFYEYDKEFIGIVKQLEGSWVIDTGSDAVCLWTEIEENEIIGNIYENKEFGGRK

SEQ ID NO: 4034 - protein, 368 aa, Streptococcus pneumoniae
  misc_feature (B) LOCATION 1...368
  hypothetical: YES
MAVCLQVEDADFTKIAKKAGLGPEVARLLFERGIQDQESLKKFLEPSLEDLHDAYLLHDMDKAVERIRQAIEVRENILVYGDYDADGMTSASIVKESLEQLGAECRVYLPNRFTDGYGPNASVYKYFIEQEGISLIVTVDNGVAGHEAIALAQSMGVDVIVTDHHSMPETLPDAYAIVHPEHPDADYPFKYLAGCGVAFKLACALLEEVQVELLDLVAIGTIADMVSLTDENRILVQYGLEMLGHTQRIGLQEMLDMAGIAANEVTEETVGFQIAPRLNALGRLDDPNPAIDLLTGFDDEEAHEIALMIHQKNEERKEIVQSIYEEAKTMVDPEKKVQVLAKEGWNPGVLGIVAGRLLEELGTDSHCS

SEQ ID NO: 4035 - protein, 218 aa, Streptococcus pneumoniae
  misc_feature (B) LOCATION 1...218
  hypothetical: YES
IRVCEEDLSMSKHYKLVFYSRIFLFLAAFTGVYLEITRHGGFGMLLYYTVLSNLLVTIFTLYLLKVMSRVGENWQRPSLLRLKGGVTMSIMITCVIYHFLLAPIATNFYTLENFLCHYIVPIWFLADTLFFDKQGQYKIWDPAVWTILPFLYMMFALFNGLVLKLNIPNAKDNPFPYFFLNVNKGWNVVFKWCLIIFVAYMVAGFIFYFIKQIKRKSS

SEQ ID NO: 4036 - protein, 206 aa, Streptococcus pneumoniae
  misc_feature (B) LOCATION 1...206
  hypothetical: YES
VASCSTKPAFSKKRLLIRSSILSMFWFLRTEIRITSSGSFEVSIVSGRSVLLSRIMRLVSWLISRSCLSCAVSGSLAFSTSRTKLASLRAFFERSTPICSTMSSVSRIPAVSINLRGTPLMLTYSSMTSRVVPAISVTIALSSRKRLLRRLDFPTLGRPMIAVEIPSRRILPRRAVLRRLVSNCSNSIVFSRTTAVVASSTSSYSG

SEQ ID NO: 4037 - protein, 73 aa, Streptococcus pneumoniae
  misc_feature (B) LOCATION 1...73
  hypothetical: YES
FLSCCNFDKFSISLFFNFFHPNLELASKRLELAFLFQATSKCLKKIISNHFFTIQEVLMTIQDFIKYELSFMA

SEQ ID NO: 4038 - protein, 139 aa, Streptococcus pneumoniae
  misc_feature (B) LOCATION 1...139
  hypothetical: YES
IRSCRTRLCLMDLLLKVLYVSMSRICTCTRTWIHGQSSLGEDENGSVAGLICDVYTTEGEPFAGDPRGNLKRALRHMEEVGFKSFNLGPEPEFFLFKLDENGDPTLEVNDKGGYFDLAPTDLADNTRREIVNVLTQNGI

SEQ ID NO: 4039 - protein, 166 aa, Streptococcus pneumoniae
  misc_feature (B) LOCATION 1...166
  hypothetical: YES
VRSWELLSRLIFEKERQKMAIEKLSPGMQQYVDIKKQYPDAFLLFRMGDFYELFYEDAVNAAQILEISLTSRNKNADNPIPMAGVPYHSAQQYIDVLIEQGYKVAIAEQMEDPKQAVGVVKREVVQVITPGTVVDSSKPDSQNNFLVSIDREGNQFGLPYMDLVNG

SEQ ID NO: 4040 - protein, 455 aa, Streptococcus pneumoniae
  misc_feature (B) LOCATION 1...455
  hypothetical: YES
VEPCGGRAAISTPLGEGAIGIVRLSGTDSFAIVQKIFKGKDLNKVASHTLNYGHIIDPLTGKVMDEVMVGAMKSPKTFTREDIIEINTHGGIAVTNEILQLAIREGARLAEPGEFTKRAFLNGRVDLTQAEAVMDIIRAKTDKAMNIAVKQLDGSLSDLINNIRQEILNTLAQVEVNIDYPEYDDVEEATTAVVREKTMEFEQLLTNLLRTARRGKILREGISTAIIGRPNVGKSSLLNNLLREDKAIVTDIAGTTRDVIEEYVNINGVPLKLIDTAGIRETDDIVEQIGVERSKKALKEANLVLLVLNASEPLTAQDRQLLEISQDTNRIILLNKTDLPETIETSKLPEDVIRISVLKNQNIDKIEERINNLFFENAGLVEQDATYLSNARHISLIEKAVESLQAVNQGLELGMPVDLLQVDLTRTWEILGEITGDAAPDELITQLFSQFCLGK

SEQ ID NO: 4041 - protein, 368 aa, Streptococcus pneumoniae
  misc_feature (B) LOCATION 1...368
  hypothetical: YES
TEPCGEDCVVTYKGGLRFHPTVNQGILKFLGFEQIFKNVLTGLPIGGGKGGSDFDPKGKTDAEVMRFCQSFMTELQKHIGPSLDVPAGDIGVGGREIGYLYGQYKRLNQFDAGVLTGKPLGFGGSLIRPEATGYGLVYYTEEMLKANGNSFAGKKVVISGSGNVAQYALQKATELGATVISVSDSNGYVIDENGIDFDLLVDVKEKRRARLTEYAAEKATATYHEGTVWTYAGNYDIALPCATQNEINGEAAKRLVAQGVICVSEGANMPSDLDAIKVYKENGILYGPAKAANAGGVAVSALEMSQNSLRLSWTREEVDDRLKDIMTNIFNTAKTTSETYGLDKDYLAGANIAAFENVANAMIAQGIV

SEQ ID NO: 4042 - protein, 74 aa, Streptococcus pneumoniae
  misc_feature (B) LOCATION 1...74
  hypothetical: YES
GKPCQAYLDWYALWGILGLTLPNLSGIGLLGDLFVGGLKAVAPILVFALVANALSQHQKGQDSNMKTVVFLYIL

SEQ ID NO: 4043 - protein, 90 aa, Streptococcus pneumoniae
  misc_feature (B) LOCATION 1...90
  hypothetical: YES
LFTCFIIHRTTIPYFVSQEVYWKVRNIEAEAIRRNCERGAIFSGKIKHHEDSQFKGDHYVECYAVLDNTVIARDRITVPIDPLCGKDFIE

SEQ ID NO: 4044 - protein, 64 aa, Streptococcus pneumoniae
  misc_feature (B) LOCATION 1...64
  hypothetical: YES
FPTWLIISLSIAWQPAKVTGLNVSYVVLDGSCLAIVFLGVHPLDMLTIMTSLVVIAGVYIIIKE

SEQ ID NO: 4045 - protein, 307 aa, Streptococcus pneumoniae
  misc_feature (B) LOCATION 1...307
  hypothetical: YES
KNTCGGSIMAIFFMIFLIVCVLLLVIVTLSTVYVVRQQSVAIIERFGKYQKVANSGIHIRLPFGIDSIAARIQLRLLQSDIVVETKTKDNVFVMMNVATQYRVNEQSVTDAYYKLIRPESQIKSYIEDALRSSVPKLTLDELFEKKDEIALEVQHQVAEEMTTYGYIIVKTLITKVEPDAEVKQSMNEINAAQRKRVAAQELAEADKIKIVTAAEAEAEKDRLHGVGIAQQRKAIVDGLAESITELKEANVGMTEEQIMSILLTNQYLDTLNTFASKGNQTIFLPNTPNGVDDIRTQILSALRAEKK

SEQ ID NO: 4046 - protein, 80 aa, Streptococcus pneumoniae
  misc_feature (B) LOCATION 1...80
  hypothetical: YES
MRTCLAHRKWALDLAESVSDNIMLNIPIKFLTAEEEAGQGFVSGNDWQIMTEEEYQAQQAVKKEENSPFAGLQGLFDGDE

SEQ ID NO: 4047 - protein, 106 aa, Streptococcus pneumoniae
  misc_feature (B) LOCATION 1...106
  hypothetical: YES
QQTWQQNLVKMLFSQVSLVVSSLDILTEKRIVDNLMALDKTLIFIAHRLTIAERTEKVVVLDQGKIVXKRXHADLLAQGGFYAHXXXXXXXXXXXXXXXXXXXXXX

SEQ ID NO: 4048 - protein, 70 aa, Streptococcus pneumoniae
  misc_feature (B) LOCATION 1...70
  hypothetical: YES
QQTWQQNLVKMLFSQVSLVVLNWKRQSTLLKMDKFSWLKTLVTKMLTARKNLKTILNLVNTGHHLEMVSS

SEQ ID NO: 4049 - protein, 283 aa, Streptococcus pneumoniae
  misc_feature (B) LOCATION 1...283
  hypothetical: YES
GYYWRGSLMAFTLPANKPQVPKDTPRNFFIYGETMSGKSYLANEFPNPIVLNTDGNAEANTVPSIQLINEKDDKGRITNSVIKQLGDILLALQTQKHSYETVVIDVIDDVIEMIKIAVCDELTPVGKPRLKSLSEIPYGKGYDFFNQAITELVIDLKALPMNVIYISRQVSEYDDNGNATKDKPSLKDKYVNLINGNSDLMIHTEKLGNNYNREVDRKRKTYYADQVDDKAILKILATIRGAVEPAKGKLAPKKEAAKTTKPAKTEKTKEAPKKEVDSDDELF

SEQ ID NO: 4050 - protein, 63 aa, Streptococcus pneumoniae
  misc_feature (B) LOCATION 1...63
  hypothetical: YES
LLYCSITLSIILNDLHSIIWHYITRIKIVLNKLYKCKKGIFRYSRVVTHFYKEIYSYDSVWHA

SEQ ID NO: 4051 - protein, 88 aa, Streptococcus pneumoniae
  misc_feature (B) LOCATION 1...88
  hypothetical: YES
EIYCSVLVSIRHMSDIKVNIPGECLYDKVFVLSFIIYNISINLNIVNGIFYIQAKKDSITFEWKAKEQTRKLAIDSSKPCFEVVDIVK

SEQ ID NO: 4052 - protein, 127 aa, Streptococcus pneumoniae
  misc_feature (B) LOCATION 1...127
  hypothetical: YES
RGELMSQVKGLCVLDVDGTLILEEVIDFLGREAGHEAEISQITSRAMRGELVFESSLRKRVSLLEGLPILVFDNVFNSIHLSLNVPEFISILQKNGILVDLVSGGFTPIVGEISKIPWYCLFHCQPA

SEQ ID NO: 4053 - protein, 80 aa, Streptococcus pneumoniae
  misc_feature (B) LOCATION 1...80
  hypothetical: YES
KQHCASLDSVYYTKTSSLKSKNPPSQAGFICIIQLDYALPSEPNTSIRSSTDAWIAFTPSAKNLRGSKSFFLSYSASFAS

SEQ ID NO: 4054 - protein, 744 aa, Streptococcus pneumoniae
  misc_feature (B) LOCATION 1...744
  hypothetical: YES
RKNCEVEMTIYINKDETVFHLAMKDSSYIFRILENGELQHLHFGKRIHVKENYNQLMAYEKRGFEVSFSEEFEDIQQSMIQNEYSSYGKGDFRHPAFQVQGMNGSRITTLKYQGFELEKGKNRLNSLPSTFDDIGQCAETLTIILTDSILDLTVRLNYTIFPEYNVLVRNTEFLNNSNNKLTLLKAMSLQLDLPDSQYDFIQFSGAWLRERQLYRTSLRPGIQAIDSLRYSSSPQQNPFFMLSRRETTEHSGEVYGFNFIYSGNFQNMIEVDHFDTARVTVGINPVEFRFLLNPAESFVTPEAIVIYSDQGMNQMSQQLSDFYRHHLVNPNFSQASRPIILNSWETFYFDLGTEKILDLAKAAKDLGIELFVLDDGWFGHRKDDKSSLGDWVTDRSRLPEGIGFLADEIHKIGLQFGLWFEPEMISIDSDLYKNHADWTIHLLDREKSVGRNQYVLDLTRQEVVDYLFDSISKIIIKTNLDYIKWDMNRHITDIYSIELDSEQQMEFGHRYILGLYQLLDRLITKFPSVLFESCSSGGGRFDLGLMYYAPQAWTSDDTDPIERLKIQHGTSYGYSPSMMTAHVSISPNEQSRRQTSLDTRTNVAYFSSFGYELDVTRLSVEEKEQVREQIQFYKKYRSLFQYGDFYRINSPFSCDSASWQVVSKDKCQSILLYAQLNSKLNPGYTRVYFSGLDKDKCYSVSGFDEFFYGDELMNAGIKVSLSNLALCVPEYLTKLFVIEEVVCK

SEQ ID NO: 4055 - protein, 69 aa, Streptococcus pneumoniae
  misc_feature (B) LOCATION 1...69
  hypothetical: YES
PRNCVFLDDIEDNIIVAPKLGIKTYQVKKRSDVVDILNNLFKLKTLYLLIRDSPLGFCVAFIKFTGKTC

SEQ ID NO: 4056 - protein, 134 aa, Streptococcus pneumoniae
  misc_feature (B) LOCATION 1...134
  hypothetical: YES
KENWQMATTELIELAIETSKHAYVPYSHFPIGAVLVAKDGNVYTGVNIENVSYPLTNCGERTAIFKAISEGQREFSELIVYGQTEKPISPCGACRQVMVEFFEQDLKVTLVAKDKSTVEMTVGELLPYSFTDLN

SEQ ID NO: 4057 - protein, 244 aa, Streptococcus pneumoniae
  misc_feature (B) LOCATION 1...244
  hypothetical: YES
QDCWVGXSYSSKAAATVHFRADHVVSGTVLNLMAPALAVFLVKVLYNKGQTDNLSQTFGRFDFPVLANIPVIGDIFFKSTSLLGYLAIAFSFLAWFILFKTQFGLRLRSVGEHPQAADTLGINVYKMRYLGIIISGFLGGIGGAIYAQSISVNFSVTTIVGPGFIALAAMIFGKWNPIGAMLSSLFFGLSQSLAVIGSQLPFLQGVPAVYLQIAPYVLTILVLAAFFGKAVAPKADGINYIKSK

SEQ ID NO: 4058 - protein, 879 aa, Streptococcus pneumoniae
  misc_feature (B) LOCATION 1...879
  hypothetical: YES
PTRCEDGKELVAEKHVDELVQKALVALEEMRKLDQEQVDYIVAKASVAALDAHGELALHAFEETGRGVFEDKATKNLFACEHVVNNMRHTKTVGVIEEDDVTGLTLIAEPVGVVCGITPTTNPTSTAIFKSLISLKTRNPIVFAFHPSAQESSAHAARIVRDAAIAAGAPENCVQWITQPSMEATSALMNHEGVATILATGGNAMVKAAYSCGKPALGVGAGNVPAYVEKSANIRQAAHDIVMSKSFDNGMVCASEQAVIIDKEIYDEFVAEFKSYHTYFVNKKEKALLEEFCFGVKANSKNCAGAKLNADIVGKPATWIAEQAGFTVPEGTNILAAECKEVGENEPLTREKLSPVIAVLKSESREDGITKARQMVEFNGLGHSAAIHTADEELTKEFGKAVKAIRVICNSPSTFGGIGDVYNAFLPSLTLGCGSYGRNSVGDNVSAINLLNIKKVGRRRNNMQWMKLPSKTYFERDSIQYLQKCRDVERVMIVTDHAMVELGFLDRIIEQLDLRRNKVVYQIFADVEPDPDITTVNRGTEIMRAFKPDTIIALGGGSPMDAAKVMWLFYEQPEVDFRDLVQKFMDIRKRAFKFPLLGKKTKFIAIPTTSGTGSEVTPFAVISDKANNRKYPIADYSLTPTVAIVDPALVLTVPGFVAADTGMDVLTHATEAYVSQMASDYTDGLALQAIKLVFENLESSVKNADFHSREKMHNASTIAGMAFANAFLGISHSMAHKIGAQFHTIHGRTNAILLPYVIRYNGTRPAKTATWPKYNYYRADEKYQDIARMLGLPASTPEEGVESYAKAVYELGERIGIQMNFRDQGIDEKEWKEHSRELAFLAYEDQCSPANPRLPMVDHMQEIIEDAYYGYKERPGRRK

SEQ ID NO: 4059 - protein, 277 aa, Streptococcus pneumoniae
  misc_feature (B) LOCATION 1...277
  hypothetical: YES
QRGCLFMKSKKWIFVLCNFLASFFLVACQSGSNGSQSAVEAIKQKGKLVVATSPDYAPFEFQSLVDGKNQVVGADIDMAQAIADELGVKLEISSMSFDNVLTSLQTGKADLAVAGISATDERKEVFDFSIPYYENKISFLVRKADVEKYKDLTSLESANIAAQKGTVPESMVKEQLPKAQLTSLTNMGEAVNELQAGKVDAVHMDEPVALSYAAKNAGLAVATVSLKMKDGDANAVALRKNSDDLKEVVDKVIQKLKDEGIYQSYLEKAASLTEVEE

SEQ ID NO: 4060 - protein, 82 aa, Streptococcus pneumoniae
  misc_feature (B) LOCATION 1...82
  hypothetical: YES
CFFCIFRDIWLDFFFSLISFGCWLRLIPLVSCFGLCFCFLVRLRFCFCRWCFCNHLTCFFLWFSCASCFCSFRCCRYSFCLF

SEQ ID NO: 4061 - protein, 66 aa, Streptococcus pneumoniae
  misc_feature (B) LOCATION 1...66
  hypothetical: YES
LPLWTALKVFYYSIISTSTCQVKTWSLKNYKRKSKPSDAMSAGSFGFDCSLPLVFSVLLLVFSQLP

SEQ ID NO: 4062 - protein, 223 aa, Streptococcus pneumoniae
  misc_feature (B) LOCATION 1...223
  hypothetical: YES
STLCDTDGSPCRTWYYLNSNGAMATGWLQNNGSWYYLNANGSMATGWLQNNGSWYYLNANGSMATGWLQNNGSWYYLNANGDMATGWLQYNGSWYYLNANGDMATGWLQYNGSWYYLNANGDMATGWLQYNGSWYYLNSNGAMVTGWLQNNGSWYYLNANGSMATGWVKDGDTWYYLEASGAMKASQWFKVSDKWYYVNGSGALAVNTTVDGYGVNANGEWVN

SEQ ID NO: 4063 - protein, 228 aa, Streptococcus pneumoniae
  misc_feature (B) LOCATION 1...228
  hypothetical: YES
KSTCLKGYYLFNFQGAKIAFVGPSGSGKSTIVRLLERFYKPLSGDILMEQSSIYDFNLKEWRSKIAWVSQNNAVLSGSIRDNLCLGLNRLVTDDELMKVLDLVSLGDEIRSMKEGLDTEVGERGRFLSGGQSQRLQIARTYLKDAEILIFDEATANLDADSEYAIISSLYSVLKEKTVVIIAHSLSTVKDVDCIFFLEEGKITGSGTHKELLENHERYARFVQEQMIE

SEQ ID NO: 4064 - protein, 76 aa, Streptococcus pneumoniae
  misc_feature (B) LOCATION 1...76
  hypothetical: YES
FGHCLNERLGEILVPVKMQVTRDRTERPHGALLQFDIECLYHMYRIGRSLRDRDASFEGDAVGILPLCYGHSNPDR

SEQ ID NO: 4065 - protein, 76 aa, Streptococcus pneumoniae; identical to SEQ ID NO: 4064
  misc_feature (B) LOCATION 1...76
  hypothetical: YES

SEQ ID NO: 4066 - protein, 76 aa, Streptococcus pneumoniae; identical to SEQ ID NO: 4064
  misc_feature (B) LOCATION 1...76
  hypothetical: YES

SEQ ID NO: 4067 - protein, 105 aa, Streptococcus pneumoniae
  misc_feature (B) LOCATION 1...105
  hypothetical: YES
KVNWMILPVTWIKLASRMRSGCPSKHVLKPRKKRSASVRHLQNQLTDQYQISYTEALEKAHELENLNLAEQEVQDLEKAIRSLGPVNLEAIDQYEEVHNRSGLSK

SEQ ID NO: 4068 - protein, 198 aa, Streptococcus pneumoniae
  misc_feature (B) LOCATION 1...198
  hypothetical: YES
SLNCTPKVRQKKSNFWGVFIMKLTYDDKVQIYELRKQGYSLEKLSNKFGINNSNLRYMIKLIDRYGIEFVKKGKNQYYSPELKQEMIDKVLHANWSQDRVSLKYALPNRGMLPNWLAQYKKNGYTIVEKTRGRPAKMERKRKKTWEEMTELERLQEENERLRTEVAYLKKLKELEERDEALERERQKQLEKWFQEDFD

SEQ ID NO: 4069 - protein, 225 aa, Streptococcus pneumoniae
  misc_feature (B) LOCATION 1...225
  hypothetical: YES
KEDCMDNRPIGFLDSGVGGLTVVRELMRQLPHEEIVYIGDSARAPYGPRPAEQIREYTWQLVNFLLTKDVKMIVIACNTATAVVWEEIKAQLDIPVLGVILPGASAAIKSSQGGKIGVIGTPMTVQSDIYRQKIHDLDPDLQVESLACPKFAPLVESGALSTSVTKKVVYETLRPLVGKVDSLILGCTHYPLLRPIIQNVMGPKVQLIDSGAECVRDISVLTQLF

SEQ ID NO: 4070 - protein, 92 aa, Streptococcus pneumoniae
  misc_feature (B) LOCATION 1...92
  hypothetical: YES
FGDWKDVAPLLEGLVENQDYVVEQDARNSAVPLLDKRAINARIEPGAIIRDQVEIGDNAVIMMGAVINIGAEIGAGTMIDMGAILGGRAIVG

SEQ ID NO: 4071 - protein, 137 aa, Streptococcus pneumoniae
  misc_feature (B) LOCATION 1...137
  hypothetical: YES
KRCCRNCDSVGRETIMNQEELAKKMLLPSKNSRLEKLGKGLTFACLSLIVILVAMILVFVAQKGLSTFFVNGVNIFDFLLGGTWNPSSKEFGCPSYDFGFLYRYHSLSPYRNTLCYWCSSFYDRSITKRGEDFATSY

SEQ ID NO: 4072 - protein, 428 aa, Streptococcus pneumoniae
  misc_feature (B) LOCATION 1...428
  hypothetical: YES
RYRCNLRNNGKRRIGIREMTEMLKGIAASDGVAVAKAYLLVQPDLSFETITVEDTNAEEARLDAALQASQDELSVIREKAVGTLGEEAAQVFDAHLMVLADPEMISQIKETIRAKKVNAEAGLKEVTDMFITIFEGMEDNPYMQERAADIRDVTKRVLANLLGKKLPNPASINEEVIVIAHDLTPSDTAQLDKNFVKAFVTNIGGRTSHSAIMARTLEIAAVLGTNNITEIVKDGDILAVNGITGEVIINPTDEQAAEFKAAGEAYAKQKAEWALLKDAQTVTADGKHFELAANIGTPKDVEGVNNNGAEAVGLYRTEFLYMDSQDFPTEDEQYEAYKAVLEGMNGKPVVVRTMDIGGDKEHPYFDMPHEMNPFLGFRALRISISETGDAMFRTQIRAPSSCVCSRSIAYHVPNGCALERIPCSESSL

SEQ ID NO: 4073 - protein, 79 aa, Streptococcus pneumoniae
  misc_feature (B) LOCATION 1...79
  hypothetical: YES
LESWRCSRTRRILADIEANMGMVIEGISTTRAAYELAQELGVYMPITQAIYQVIYHGTNIKDAIYDIMNNEFKAENEWS

SEQ ID NO: 4074 - protein, 377 aa, Streptococcus pneumoniae
  misc_feature (B) LOCATION 1...377
  hypothetical: YES
GGGCMKKVKLGEVLSLKKGKKATVLAEQTTLSQRYIQIDDLRNNNNLKFTESLNMTEALPDDILIAWDGANAGTVGYGLSGAVGSTITVLKKNERYKEKIISDYLGVFLESKSQYLRDHSTGATIPHLNKNILLDLQLELLGIEEQENIICILNTIKRLITKRKFQLDELNLLVKSRFNEMFGENKIFESIDNLFDIIDGDRGKNYPKSDELFSEEYCLFLNTKNVTKNGFSFDTKQFITKTKDKLLRKGKLERYDIVLTTRGTVGNVAYYDELIKYKHLRINSGMVILRPKTPNLNQKFIIHVLRNNNYSRVISGSAQPQLPITKLKKILLPLPPLALQNEFADFVVQVDKSQLAIQKSLEELETLKKSLMQEYFG

SEQ ID NO: 4075 - protein, 165 aa, Streptococcus pneumoniae
  misc_feature (B) LOCATION 1...165
  hypothetical: YES
HEGWTKDRVSLEYCLPSRTILLNWLAQYRKNGYTIVEKTRGRVPESGKCHPKKVKRTPIEGGKRERRKTEIVQELITEFSLDLLLKAIKLARSTYYYHLKQLDKTDKDQELKAEIQSIFIEHKGNYAYRRIYLELRNRAYLVNYKRVQGLMKVLNLQAKMRQKRK

SEQ ID NO: 4076 - protein, 165 aa, Streptococcus pneumoniae
  misc_feature (B) LOCATION 1...165
  hypothetical: YES
HEGWTKDRVSLEYCLPSRTILLNWLAQYRKNGYTIVEKTRERVPEIGECHPKKVKRTPIEGGKRERRKTEIVQELMTEFSLDLLLKAIKLARSTYYYHLKQLDKPDKDQELKAEIQSIFIEHKGNYAYRCIHLELRNRGYLVNHKRVQGLMKVLNLQAKMRQKRK

SEQ ID NO: 4077 - protein, 165 aa, Streptococcus pneumoniae
  misc_feature (B) LOCATION 1...165
  hypothetical: YES
HEGWTKDRVSLEYGLPSRTILLNWLAQYRKNGYTIVEKTRGRVPESGECHPKKVKRTPIEGGKRERRKTEIVQELMTEFSLVLLLKAIKLARSTYYYHLKQLDKTDKDQELKAEIQSIFIEHKGNYAYRCIHLELRNRAYLVNHKRVQGLIKVLNLQAKMRQKRK

SEQ ID NO: 4078 - protein, 100 aa, Streptococcus pneumoniae
  misc_feature (B) LOCATION 1...100
  hypothetical: YES
HEGWTKDRVSLEYGLPSRTILLNWLAQYRKNGYTIVEKTRGRVPKMGRKPKTIPEERTELEHLQAENEYLRAENAILKKLRELRLKEEKEKEERQKLFKN

SEQ ID NO: 4079 - protein, 100 aa, Streptococcus pneumoniae
  misc_feature (B) LOCATION 1...100
  hypothetical: YES
HEGWTKDRVFFEYGFPSCTIIFNWLAQYRKNGYNIVEKTRGRVPKMGRKPKTIPEERTELERFQAENEYLRAENAILKKLRELRLKEEKEKEERQKLFKN

SEQ ID NO: 4080 - protein, 792 aa, Streptococcus pneumoniae
  misc_feature (B) LOCATION 1...792
  hypothetical: YES
FILWRSRFLECGGFNMVEFIKSKKEMSEEDIKANFITPAIVSKGWKNGEHIAYEEYFTDGRIEVRGDKARRKEGKKSDYSLYYQFGTRIAIVEAKDNKHSVRAGLQQAIEYGEILDVPFVYSSNGDGFIEHDRITREERELELDEFPTREELFSRMTKEKGLTYEITEAISTPYYTDAFSMKTPRYYQQIAINRTIETVARGQKRVMFVMATGTGKTFMAFQIIHRLRKAGLAKRVLFLADRNILVDQTMAEDFRPFEKVMTKITPKLLTAPEKLNSFEIYLGLYQQLTGEDGTETHYQKFDKDFFDLIVIDEAHRGSAKENSNWRKIIDYFSSATQIGMTATPKETKNASNTEYFGEPIYTYSLKQGIEDGFLAPYRVMRVNLDVDVDGYRPETGKVDANGQLIEDRYYGRKDFDKTIVIDDRTQRVAKFVSDYMKQNNARFDKTIVFCVDIDHAERMRAALVKENLDLVQEDYRYVMQVTGDNAEGKAQLDNFMDVNSNFPAIVTTSKLLTTGVNAKTCRLIVLDSNIQSMTEFKQIIGRGTRLYPQKGKEFFTIIDFRNVTNLFADPDFDGDPVKVLETGAKTVSGSTPGFVGEEGDPVEKYIVTDKQVTILNSTVQVLDENGKLITESLTDYTRKNILGSYATLNDFITVWHTADKKKLILDELYKKGVYLDAIRESEGISEQEIDDFDLLLKLAYGQKELTKTERINKLKQSGYLYKYSEEARAVLEILLNKYMDKGIGELESIETLKLPEFQIYGGTFKIINTYFGDKKRYLQAIKELEQELFTVA

SEQ ID NO: 4081 - protein, 128 aa, Streptococcus pneumoniae
  misc_feature (B) LOCATION 1...128
  hypothetical: YES
KHLWVVRMIDHFEIKVKDLQISEGFYRSFLAPLDYKLAFKTSSLISFLSPNSPHPGGDFWLTQGTQDPVHFAFLAENKEEVQACYEAGIEAGGRDNGVPGYRSEHPIYYAAFMIDLDGNNIEVVCHKE

SEQ ID NO: 4082 - protein, 196 aa, Streptococcus pneumoniae
  misc_feature (B) LOCATION 1...196
  hypothetical: YES
MNLWDIFFTTQATEPPKFDLFWYVSLFTLLALTFYTAHRYREKKVYQRFFQILQTVQLILLYGWYWVNHMPLSESLPFYHCRMAMFVVLLLPGQSKYKQYFALLGTFGTLAAFVYPVPDAYPFPHITILSFIFGHLALLGNSLVYLLRQYNARLLDVKGIFLMTFALNALIFVVNLVTGGDYGFLTKPPIGWGITF

SEQ ID NO: 4083 - protein, 286 aa, Streptococcus pneumoniae
  misc_feature (B) LOCATION 1...286
  hypothetical: YES
MDLWFSEVHTPDVKLSLRTAKQLYAGKSEWQDIEVLDTPAFGKILILNGHVLFSDADDFVYNEMTVHVPMAVHPNPKKVLVIGGGDGGVAQVLTLYPELEQIDIVEPDEMLVEVCREYFPDFAAGLDDPRVTIYYQNGLRFLRNCEDDYDIIINDATDPFGHTEGLFTKEFYGNSYRALKEDGIMIYQHGSPFFDEDESACRSMHRKVNQAFPISRVYQAHIPTSPAGYWLFGFASKKYHPVKDFDKEGWKKRQLFTEYYTANLHVGSFMLPKYVEDILEEEEGKK

SEQ ID NO: 4084 - protein, 85 aa, Streptococcus pneumoniae
  misc_feature (B) LOCATION 1...85
  hypothetical: YES
FCLCFSGCWTYCGRLNMVEIKNLSLDYGEEHILDDISLSIAEGECVLFTGKSGDGKSSLINSINGLAVRYDNAQTKGEIIMKVRI

SEQ ID NO: 4085 - protein, 941 aa, Streptococcus pneumoniae
  misc_feature (B) LOCATION 1...941
  hypothetical: YES
GLLWNRRGGHDLSKKRLYEIAKELGKESKEVVARAKELGLDVKSHSSSVEEAVAAKIAASFKPAAAPKVEAKPAAPKVSAEKKAEKSEPAKPAVAKEEAKPAEPVAPKTEKVAAKPQSRNFKAEREARAKEQAERRKQNKGNNRDQQQNGNRQKNDGRNGGKQGQSNRDNRRFNDQAKKQQGQQKRRNERRQQEDKRSNQVAPRIDFKARAAALKAEQNAEYARSSEERFKQYQAAKEALAQANKRKEPEEIFEEAAKLAEQAQQVQAVVEVVPEKKEPAVDTRRKKQARPDKNRDDYDHEEDGPRKQQKNRSSQNQVRNQKNSNWNNNKKNKKGNNKNNRNQTPKPVTERKFHELPTEFEYTDGMTVAEIAKRIKREPAEIVKKLFMMGVMATQNQSLDGETIELLMVDYGIEAKQKVEVDNADIERFFVEDGYLNEDELVERPPVVTIMGHVDHGKTTLLDTLRNSRVATGEAGGITQHIGAYQIVENGKKITFLDTPGHAAFTSMRARGASVTDITILVVAADDGVMPQTIEAINHSKAANVPIIVAINKIDKPGANPERVIGELAEHGVMSTAWGGDSEFVEISAKFNQNIEELLETVLLVAEIQELKADPTVRAIGTVIEARLDKGKGAVATLLVQQGTLNVQDPIVVGNTFGRVRAMTNDLGRRVKVAGPSTPVSITGLNEAPMAGDHFAVYEDEKSARAAGEERAKRALMKQRQATQRVSLENLFDTLKAGELKSVNVIIKADVQGSVEALSASLQKIDVEGVKVTIVHSAVGAINESDVTLAEASNAFIVGFNVRPTPQARQQAEADDVEIRLHSIIYKVIEEMEEAMKGMLDPEFEEKVIGEAVIRETFKVSKVGTIGGFMVINGKVARDSKVRVIRDGVVIYDGELASLKHYKDDVKEVTNGREGGLMIDGYNDIKMDDVIEAYVMEEIKR

SEQ ID NO: 4086 - protein, 90 aa, Streptococcus pneumoniae
  misc_feature (B) LOCATION 1...90
  hypothetical: YES
KQLCTILDSLFYTKMSREEKVKVYAQTLHIRTLAYPFYGILHYPLKLPDSYPSKIYSNHVSFTLYMLVTSQVLSATSKLFFEQPTASFLV

SEQ ID NO: 4087 - protein, 77 aa, Streptococcus pneumoniae
  misc_feature (B) LOCATION 1...77
  hypothetical: YES
QVLCCLTTLRYEMKTAIGLMALDQSRYFDMTDYELELEVENHEQGKQDFRQFLEKNQISYQKAPSKLVRFVKSMKNS

SEQ ID NO: 4088 - protein, 408 aa, Streptococcus pneumoniae
  misc_feature (B) LOCATION 1...408
  hypothetical: YES
ACLWIRTLIMRLTQMPSEFQKALPVLEKIKEAGFEAYFVGGSVRDALLHSPIHDVDIATSSYPEETKQIFPRTADIGIEHGTVLVLDGDEEYEVTTFRTEDVYVDYRRPSAVSFVRSLEEDLKRRDFTVNAFALDETGEIVDLFHGLEDLEKQVLRAVGVASERFNEDALRIMRGFRFQASLGFALEPETFKAMKTLTPLLEKISVERTFVEFDKLLLAPFWRRGLASMIESQAYDYLPDMASSQDKLNRLFDLETDFTFESSEQAWAALLWALEIENAQSFLKSWKTSRQFAKQVQDLLIILALRENGELSKRDCYRFDIDLLLQAENLRQAQGKEVNPQAITEKYQSLTIHDKKEIQINGGILIKEYGYQPGPDLGEILTEIEFAIVDGELENNREAIHAYLREKK

SEQ ID NO: 4089 - protein, 96 aa, Streptococcus pneumoniae
  misc_feature (B) LOCATION 1...96
  hypothetical: YES
NSLWKEGESMSKMSMSIRLDSEVKEQAQQVFSNLGMDMTTAINIFLRQAIQYQGLPFDVRLDENRKLLQVLTDLDQNRNMSQSFESVSDLMEDLRA

SEQ ID NO: 4090 - protein, 102 aa, Streptococcus pneumoniae
  misc_feature (B) LOCATION 1...102
  hypothetical: YES
FCLCDSSPRFRSKATLSLVNCEPLEAYRQLEEAELVGCWAHVRRKFFEATPKQADKSSLGAKGLAYCDQLFSLERDWEALPADERLQKRQEHLQPLMEDFFA

SEQ ID NO: 4091 - protein, 633 aa, Streptococcus pneumoniae
  misc_feature (B) LOCATION 1...633
  hypothetical: YES
SHPCLPEGEKMSDFIVEKLSKSVGDKTVFRDISFIIHDLDRIGLIGVNGTGKTTLLDVLSGVSGFDGDVSPFSAKNDYQIGYLTQDPDFDDRKTVLDTVLSSELKEIQLIREYELIMLDYSEDKQARLERVMAEMDSLQAWEIESQVKTVLSKLGIQDLSTPVGELSGGLRRRVQLAQVLLGNHDLLLLDEPTNHLDIAIIEWLTLFLKNSKKTVLFITHDRYFLDALSTRIFELDRAGLTEYQGNYQDYVRLKAEQDERDAALLHKKEQLYKQELAWMRRQPQARATKQQARINRFHDLKKEVSGSSAETDLTMNFETSRIGKKVIEFQAVSFAYENKPILQNFNLLVQAKDRIGIVGDNGVGKSTLLNLIAGSLEPTAGQVVIGETVRIAYFSQQIEGLDESKRVINYLQEVAEEVKTSGGSTTSIAELLEQFLFPRSTHGTLIEKLSGGEKKRLYLLKLLLEKPNVLLLDEPTNDLDIATLTVLENFLQGFAGPVLTVSHDRYFLDKVATKILAFEDGKIRPFFGHYTDYLDEKAFETDMANQVQKAEKEKVVKVREDKKRMTYQEKQEWASIEGDIETLEKRIAAIEEEMQANGSDFGKLATLQKELDEKNEALLEKYERYEYLSEFDS

SEQ ID NO: 4092 - protein, 272 aa, Streptococcus pneumoniae
  misc_feature (B) LOCATION 1...272
  hypothetical: YES
KCPCGQRLGRSGNLAVTERISMPTILITGASGGLAQEMVKLLPNDQLILLGRNKEKLAQLYGNYSHAELIEIDITDDSALEALVTDLYLRYGKIDVLINNAGYGIFEGFDQIADKDIHQMFEVNTFALMNLSRHLAARMKESSKGHIINIVSMAGLIATGKSSLYSATKFAAIGFSNALRLELMPYGVYVTTVNPGPIRTGFFDQADPDGTYLKSVDRFLLEADAVAKKIVKIIGKNKRELNLPILLNLAHKFYTLFPKLADKLAGETFNYK

SEQ ID NO: 4093 - protein, 463 aa, Streptococcus pneumoniae
  misc_feature (B) LOCATION 1...463
  hypothetical: YES
RGKCMLRFPKVFVWGSSTSGPQTEGLVAGDGKGDNLWDYWFQVEPNRYYNGIGSDKTSTFYENWERDIELLLETGHTAFRTSIQWSRIFPQGCGKVNTQGVDFYRKVFEAIKAKGIRLLVNLYHFDLPFALQEDGDGWENKATVSAYEDYARFCFETYGDLVDQWITFKEPIVPVEFGYFYDAHYPHKVDAEPAVKVAYHTQLASSRAVKACHELLPDSKIGIVLNLTPAYPRSQHPADVKAARIAALFQAQSFLDPSVLGTYPQELVEILHEHGLLPDATEEELELIRDNTVDFLGVNYYQPLRVMAPRFAKHPESPLLPEHFYEPYVMPGRKINSHRGWEIYEQGIYDIAQNIKENYGNIEWMLTENGMGVEGEEKFRQDGMIQDDYRIDFVKGHLRELHRAIEDGANCKGYLIWTFIDCWSWLNSYKNRYGLVELDLETQERRLKKSGHWFKELSDNNGF

SEQ ID NO: 4094 - protein, 80 aa, Streptococcus pneumoniae
  misc_feature (B) LOCATION 1...80
  hypothetical: YES
LPKWKKVKGISRMDLSNKASNLRKKLGADGESPIDIFKLVQKIENLTLVFYGLGKNISGVCYKGTQFSLIAVNSDMPLGR

SEQ ID NO: 4095 - protein, 286 aa, Streptococcus pneumoniae
  misc_feature (B) LOCATION 1...286
  hypothetical: YES
EEKWMKKWMKKWMLVLVSLMTALFLVACGKNSSETSGDNWSKYQSNKSITIGFDSTFVPMGFAQKDGSYAGFDIDLATAVFEKYGITVNWQPIDWDLKEAELTKGTIDLIWNGYSATDERREKVAFSNSYMKNEQVLVTKKSSGITTAKDMTGKTLGAQAGSSGYADFEANPEILKNIVANKEANQYQTFNEALIDLKNDRIDGLLIDRVYANYYLEAEGVLNDYNVFTVGLETEAFAVGARKEDTNLVKKINEAFSSLYKDGKFQEISQKWFGEDVATKEVKEGQ

SEQ ID NO: 4096 - protein, 196 aa, Streptococcus pneumoniae
  misc_feature (B) LOCATION 1...196
  hypothetical: YES
CRKCRSTFACSSINIKAGSTSQSYSILISKRKKKEMKKIVLVSLAFLFVLVGCGQKKETGPATKTEKDTLQSALPVIENAEKNTVVTKTLVLPKSDDGSQQTQTITYKDKTFLSLTIQQKRPVSDELKTYIDQHGVEETQKALLEAEEKDKSIIEARKLAGFKLETKLLSATELQTTTSFDFQVLDVKEGSPSGNI

SEQ ID NO: 4097 - protein, 334 aa, Streptococcus pneumoniae
  misc_feature (B) LOCATION 1...334
  hypothetical: YES
KGECLEMGKSVAILMTTYNGERYLSQQIDSIRSQTFTNWTLFIRDDGSKDKTVEVIQRYSKIDDRIRLVENPSKFHGAYYNFFNLIEYVKNNYQFDYYFFCDQDDIWKEHKLEIQLLRFSKDEMPEMVYSDMSTIDANNKLIDISINNIMGIELPNINNLYFIHAYIWGCTAGFNHALLEMVPSVDIDKDYLYIEKLSHDNYFAKFALEYGKVLFCPEQLVLYRRHGHNVTTSHHFKLSPLNILRKAILGFNELALTHAGVYNQTLYMLKKASEKSPLSDRLLEIQEVIKIGGLKGVRYFCQNRISRKQLVRTIGLYTIMLFGTYKKYIMKELS

SEQ ID NO: 4098 - protein, 676 aa, Streptococcus pneumoniae
  misc_feature (B) LOCATION 1...676
  hypothetical: YES
NKECTMKKLFILISNLLASLFFVWVFTIWTDTYVSYYYSNVVVHDSSPETTFQHVATRLEKLAEETDSFIAIQHQDPNSEGTTVFSYTTFGDGKLPDGLQEKKLEDAQSSSVETNYFVFDGHLDIHLLREELSQLGLTNMNLTIPSKLSTLMAIFSNGFQLISLLIFILTFVALTLISQISQLRSSGIRLISGEKRWSIFLRPVGEDLKGIAVGFSLAGVLAILMQKILSLPTQSLMTIGAGLLSYNLILLSISLFFAQLFAVGIKKIHLMQIIKGQVPVRGIISLILIGQLLAIIIVTLGIGSSLKYSQAWQQHRIGQEAWSQERQLITLSISREGTSPGFDEQAQRKLRTWYQLMDLAVSEQKAFLSRHQLIDRTLQNGMASSKNLITSTEWHDYNPNGNVLIVTPQYLERQNIPVDTTIEQKMNHLDVGEFVLLLPEHLRSEEEHYKSVFEDDLTSRMSSQDERQQMTATVGYLESGQDRFVYNTTPISYQQFLKDPIIIVITPQSTGPQSILFWIDAVQNYVLFNQLSDAQELIQRQGIENWVSEMQTGYHNYITLLDNIQRERWVMLAGAVLGIATSILLFNTMNRLYFEEFRRAIFIKRIAGLRFLEIHRTYLFAQLGVFLLGFVASVFLQVEIGVAFLVLLLFTGLSLLQLHVQMQKENKMSILVLKGG

SEQ ID NO: 4099 - protein, 72 aa, Streptococcus pneumoniae
  misc_feature (B) LOCATION 1...72
  hypothetical: YES
SFRCLSRRVECLGKTGQLFSFHDNPNPNCPVGAHIHDVLDQKLERIQLTMEAELGQTSLEKVVADAESQMKD

SEQ ID NO: 4100 - protein, 295 aa, Streptococcus pneumoniae
  misc_feature (B) LOCATION 1...295
  hypothetical: YES
ETRCGSTGFNGILQRKERGMQAKLIGYQHRDTVIHRLSGAGKLLFFILVSLAAMISYDTRMLLLIAIFSVFLLYLSEIRFKDVSFVAVFATVFAVLNVLMVYLFSPEYGVGLYGERSVIWQGIGVYTLTSQELFYLLNLAIKYLCTIPLAIIFLMTTHPSQFASSLNQIGVPYKIAYSVSLTLRYIPDLQEEFFTIKMSQEARGMELSKKASLMQRIKGNLLIITPLIFSSLERIDTIATAMELRRFGKEKKRTWYSYQALKKGDYITLLLATLFLVVSLLLILQNQGRFYNPWK

SEQ ID NO: 4101 - protein, 182 aa, Streptococcus pneumoniae
  misc_feature (B) LOCATION 1...182
  hypothetical: YES
TGGCEQMTLNYIEILIKLVLTLKWLNNNVHFVKRLIDGKPTLLIKNGNIDPEACRSVGLSASDVALKLRSQGIFQMKQVKRAVQEQNGQLIVVQMGDENPKYPVVTDGVIQVDVLESIGRSEEWLLDNLSKQGHDNVANIFIAEYDKGAVTVVTYEKEKPGVLYSSKISSNRVNVALPYVGY

SEQ ID NO: 4102 - protein, 88 aa, Streptococcus pneumoniae
  misc_feature (B) LOCATION 1...88
  hypothetical: YES
LEGCLSELFSKEEILESDMRVAIMSELIEARNKQGISQKKLEEVSGVSQPVIARMETGKTSPQLDTVLKVLASLGKTLAVVPLEQGKS

SEQ ID NO: 4103 - protein, 576 aa, Streptococcus pneumoniae
  misc_feature (B) LOCATION 1...576
  hypothetical: YES
ELGCGISLSVICWNLSMKSSMKNWRQNRMKQFWLHTLLRTYSSVMIIIIASFAILLSYADWDSREKEAQRVAQRVTARTVSEIEYYHRESTQIAQALVENQARIEGIYKYFSLSMPDYFYWQLERKASPYISVSLYENVDDLYVRNDFVTGVAIAFQDYKEVYVSTKDKRSGEKIRAEDFKPAGNSFAIPVSDPVSDQDLGVIYISLDPAVLYHAIDNTRGHTPMAVTVTSPFDTEIFHIGETVDRESENWLVGLTSHGYQVQVAVPKNFVLQGTVTSSALIVGLSLLFIVILYLTLRQTFANYQKQVVDLVESIQVIAQGEEGRRIDISEKDQELLLIAETTNDMLDRLEKNIHDIYQLELSQKDANMRALQAQINPHFMYNTLEFLRMYAVMQSQDELADIIYEFSSLLRNNISDERETLLKQELEFCRKYSYLCMVRYPKSIAYGFKIDPELENMKIPKFTLQPLVENYFAHGVDHRRTDNVISIKALKQDGFVEILVVDNGRGMSAEKLANIREKLSQRYFEHQASYSDQRQSIGIVNVHERFVLYFGDRYAITIESAEQAGVQYRITIQDE

SEQ ID NO: 4104 - protein, 162 aa, Streptococcus pneumoniae
  misc_feature (B) LOCATION 1...162
  hypothetical: YES
LFLCRLRERTRMTQQDFRTKVDNTVFGVRATALILQNRKLLVTKDKGKYYIIGGAIQVNEKTEDAVVREVKEELGVKSQAGQLAFVVENRFEVDGVSYHNIEFHYLVDLLEDAPLTMQEDEKRQPCEWIDLDKLQNIQLVPAFLKTALPDWEGQLRHIHLEE

SEQ ID NO: 4105 - protein, 419 aa, Streptococcus pneumoniae
  misc_feature (B) LOCATION 1...419
  hypothetical: YES
LVLWSYKMLKRLWMIFGPVLIAGLLVFLLIFFYPTEMHHNLGAEKRSAVATTIDSFKERSQKVRALSDPNVRFVPFFGSSEWLRFDGAHPAVLAEKYNRSYRPYLLGQGGAASLNQYFGMQQMLPQLENKQVVYVISPQWFSKNGYDPAAFQQYFNGDQLTSFLKHQSGDQASQYAATRLLQQFPNVAMKDLVQKLASKEELSTADNEMIELLARFNERQASFFGQFSVRGYVNYDKHVAKYLKILPDQFSYQAIEDVVKADAEKNTSNNEMGMENYFYNEQIKKDLKKLKDSQKSFTYLKSPEYNDLQLVLTQFSKFKVNPIFIIPPVNKKWMDYAGLREDMYQQTVQKIRYQLESQGFTNIADFFKDGGEPFFMKDTIHLGWLGWLAFDKAVDPFLSNPTPAPTYHLNEFFSATLGP

SEQ ID NO: 4106 - protein, 399 aa, Streptococcus pneumoniae
  misc_feature (B) LOCATION 1...399
  hypothetical: YES
NLLCYTRDMLDLKEYGIVMWPEEKVISFREKLLAWYDENKRDLPWRRSKNPYHIWVSEIMLQQTRVDTVIPYYERFLDWFPTVESLATAPEESLLKAWEGLGYYSRVRNMQAAAQQIMTDFGGQFPNTYEGISSLKGIGPYTAGAISSIAFNLPEPAVDGNVMRVLARLFEVNHDIGIPSNRKIFQAMMEILINPDRPGDFNQALMDLGSDIESPVNPRPEESPVKDFSAAYQNGTMDRYPIKSPKKKPVPIYLKALVVKNSQGQFLLEKNESEKLLAGFWHFPFIEVDNFSQEEQFDLFHQVAEESVNFGPSPEESFQQDYDLDVDWLDVCFDTVQHVFSHRKWHVQIVAGQVSDFHDFSDREVRWLSPEEFKNYPLAKPQQKIWQAYAQANLDSSQD

SEQ ID NO: 4107 - protein, 367 aa, Streptococcus pneumoniae
  misc_feature (B) LOCATION 1...367
  hypothetical: YES
IIMWLQHLSLKTFRNYKETKIDFNPKLNVFLGRNAQGKTNMLEAIYFLALTRSHRTRTDKNLIHFDEEQLHLSGLVQKKTGSIPLEIELTQKGRVTKVNHLKQARLSDYVGHMNVVLFAPEDLQLIKGAPSIRRKFIDMELGQIKPIYLSDLTNYNHILKQRNTYLKSAQKIDETFLSVLDDQLVDYGCRVMNHRLDFIKKLESFGRKKHFELSNQIEELSISYQSSVNITDKQNLSESFKIALEKSRSRDLFKKNTGVGPHRDDISFYINGMDASFGSQGQHRSLVLSIKLAEIELMESITTESPILLLDDVMSELDNTRQLKLLETISQSIQTFITTTSLDHLQNLPENLSIFTIQDGKAAVNGN

SEQ ID NO: 4108 - protein, 117 aa, Streptococcus pneumoniae
  misc_feature (B) LOCATION 1...117
  hypothetical: YES
YTMWYNLLMAYSIDFRKKVLSYCERTGSITEASHVFQISRNTIYGWLKLKKKTGELNHQVKGTKPRKVDRDRLKNYLTDNPDAYLTEIASEFGCHPTTIHYALKAMGYTRKKEPHLL

SEQ ID NO: 4109 - protein, 117 aa, Streptococcus pneumoniae
  misc_feature (B) LOCATION 1...117
  hypothetical: YES
YTMWYNLLMAYSIDFRKKVLSYCERTGSITEASHVFQISRNTIYGWLKLKEKTGELNHQVKGTKPRKVDRDRLKNYLTDNPDAYLTEIASEFGCHPTTIHYALKAMGYTRKKEPHLL

SEQ ID NO: 4110 - protein, 117 aa, Streptococcus pneumoniae
  misc_feature (B) LOCATION 1...117
  hypothetical: YES
YTMWYNLFMAYSIDFRKKVLSYCERTGSITEASHVFQISRNTIYGWLKLKEKTGELNHQVKGTKPRKVDRDRLKNYLTDNPDAYLTEIASEFGCHPTTIHYALKAMGYTRKKEPQLL

SEQ ID NO: 4111 - protein, 298 aa, Streptococcus pneumoniae
  misc_feature (B) LOCATION 1...298
  hypothetical: YES
KRMWIRSRETMKKVLQKYWAWAFVVIPLLLQAIFFYVPMFQGAFYSFTNWTGLTYNYKFVGLNNFKLLFMDPKFMNAIGFTAIITIAMVVGEIALGIFIARVLNSKIKGQTFFRAWFFFPAVLSGLTVALIFKQVFNYGLPAIGNALHIEFLQTSLLGTKWGAIFAAVFVLLWQGVAMPIIIFLAGLQSIPTEITEAARIDGATSKQVFWNIELPYLLPSVSIVFILALKGGLTAFDQVFAMTGGGPNNATTSLGLLVYNYAFKNNQFGYANAIAVILFFLIVVISIIQLRVSKKFEI

SEQ ID NO: 4112 - protein, 109 aa, Streptococcus pneumoniae
  misc_feature (B) LOCATION 1...109
  hypothetical: YES
LLQCANGSLNLEKLEAMTAICSVGLDMIAIPEDTPAETIAAMIADEAAIGVINMKTTAVRIIPKGREGDMIEFGGLLGTAPVMKVNGASSVDFISRGGQIPAPIHSFKN

SEQ ID NO: 4113 - protein, 225 aa, Streptococcus pneumoniae
  misc_feature (B) LOCATION 1...225
  hypothetical: YES
EVKCMNQDRNKLLSKIAYLYYIENLNQSQIAAKLGIYRTSISRMLTEARNVGIVKIEIENFDTNMFKLENYVKEKYSLESLEIIPNEFDDTPTILSERISQVAAGVLRNLIDDNMKIGFSWGKSLSNLVDLIHSKSVRNVHFYPLAGGPSHIHAKYHVNTLIYEISRKFHGECTFMNATIVQENKLLADGILQSRYFENLKNSWKDLDIAVVGIGDFSNKGKHQW

SEQ ID NO: 4114 - protein, 271 aa, Streptococcus pneumoniae
  misc_feature (B) LOCATION 1...271
  hypothetical: YES
DCKWIIRRICEVDERRKKMNKRGLYSKLGISVVGISLLMGVPTLIHANELNYGQLSISPIFQGGSYQLNNKSIDISPLLLDKLSGESQTVVMKFKADKPNSLQALFGLSNSKAGFKNNYFSIFMRDSGEIGVEIRDAQKGINYLFSRPASLWGKHKGQAVENTLVFVSDSKDKTYTMYVNGIEVFSETVDTFLPISNINGIDKATLGAVNREGKEHYLAKGSIGEISLFNKAISDQEVSNIPLSNPFQLIFQSGDSTQANYFRIPTLLKVL

SEQ ID NO: 4115 - protein, 311 aa, Streptococcus pneumoniae
  misc_feature (B) LOCATION 1...311
  hypothetical: YES
DMKWTKRVIRYATKNRKSPAENRRRVGKSLSFISVLVFAIFLVNFAVIIGTGTRFGTDLAKEAKKVHQTTRTVPAKRGTIYDRNGVPIAEDATSYNVYAVIDENYKSATGKILYVEKTQFNKVAEVFHKYLDMEESYVREQLSQPNLKQVSFGAKGNGITYANMMSIKKELEAAEVKGIDFTTSPNRSYPNGQFASSFIGLAQLHENEDGSKSLLGTSGMESSLNSILAGTDGIITYEKDRLGNIVPGTEQVSQRTMDGKDVYTTISSPLQSFMETQMDAFQEKVKGKYMTATLVSAKTGEILATTQRPDL

SEQ ID NO: 4116 - protein, 345 aa, Streptococcus pneumoniae
  misc_feature (B) LOCATION 1...345
  hypothetical: YES
NKEWNMTVTIDWENLGFSYMKLPYRYLAHFKNGQWDQGELTEDATLHISESSPSLHYGQQAFEGLKAYRTKDGSVQLFRPDENAKRLQRTCDRLLMPQVPTDMFVEACKAVVRANEEYVPPYGTGGTLYLRPLLIGVGDIIGVKPAEEYIFTIFAMPVGNYFKGGLVPTNFLIQDEYDRAAPNGTGAAKVGGNYAASLLPGKMAKSRHFSDVIYLDPSTHTKIEEVGSANFFGITADNEFVTPLSPSILPSITKYSLLYLAEHRLGLTPIEGDVPIDNLDRFVEAGACGTAAVISPIGGIQHGDDFHVFYSETEVGPVTRKLYNELTGIQFGDIEAPEGWIVKVD

SEQ ID NO: 4117 - protein, 166 aa, Streptococcus pneumoniae
  misc_feature (B) LOCATION 1...166
  hypothetical: YES
ESWCLMKILAIDPSSNKIETSTTGVVLLDNARLVDSWVVSYGMRGFADWFHEIGTNLEFDVVIVEEFKARDNDKSKDNSVAETIAYIQLCYPGAILQFNAGYKSDIPNDLLKILDLWKFEKSHHQDIRAAARLGLFWAMRNDIEEVVHDIGKVVSEYHNNAKKVAS

SEQ ID NO: 4118 - protein, 120 aa, Streptococcus pneumoniae
  misc_feature (B) LOCATION 1...120
  hypothetical: YES
GGRCGLVAEWGGCAGAGWGGEAGAVWARGGAADSCGGGRGGVGVRRAVVGVGGGSCSRAVGDWPRGGGRHAGERGVEGSGVAGVEAGAVRGRVEWGEWGAVGVRRAVSAGRYGLHGCVPW

SEQ ID NO: 4119 - protein, 109 aa, Streptococcus pneumoniae
  misc_feature (B) LOCATION 1...109
  hypothetical: YES
KSRWAGQALLVGSQPVAANEHHAILAFESNFNAGQTMKRDNLNTMFGNILSQAAGFSPEILAISMEEWKEVRAAFSAKAKSSQTEKEVEESLIPEGFEFLADKVKVEED

SEQ ID NO: 4120 - protein, 287 aa, Streptococcus pneumoniae
  misc_feature (B) LOCATION 1...287
  hypothetical: YES
EKRCPMIKKIYPIFTILLGAAIYAFGLTYFVVPHHLFEGGATGITLITFYLFKIPVSLMNLLINIPLFILAWKIFGAKSLYSSLLGTLALSGWLAFFEHIPLHIDLQGDLLITALIAGILLGIGLGIIFNAGGTTGGTDILARILNKYTHISIGKLLFILDFCILMLILLIFKDLRLVSYTLLFDFIVSRVIDLIGEGGYAGKGFMIITKRPDQLAKAINDDLGRGVTFISGQGYYSKENLKIIYCIVGRNEIVKTKEMIHRIDPQAFITITEAHEILGEGFTFEKE

SEQ ID NO: 4121 - protein, 375 aa, Streptococcus pneumoniae
  misc_feature (B) LOCATION 1...375
  hypothetical: YES
PRRCLMNDKLKIFLLLGVFFLAITGFYVLLIRNAGQTDASQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 4122 - protein, 248 aa, Streptococcus pneumoniae
  misc_feature (B) LOCATION 1...248
  hypothetical: YES
NSGCLSYLSNIRPWKGEKMSKENPLSHHEQLRYDYLLKNIHYLNEREKNEFAYLQEKLTLARGNSSSSLEQEREEQVDLPSYANRSRSQSKSQALSFPPKKKRRKLRLKRIFMVIFSLLVCVALAMVFMFLRGYQDASAKKTADARAAQVEVFNGQDTRDGVNILIMGTDGRIGQNSVETRTDSIMVLNVGGSDKKMKLVSFMRDNLVYIDGYSQVINGRKQTDNKLNVAYELGEQEGKKGQKCFAKS

SEQ ID NO: 4123 - protein, 267 aa, Streptococcus pneumoniae
  misc_feature (B) LOCATION 1...267
  hypothetical: YES
GRFRMSAYQLPTVWQDEASNQGAFTGLNRPTVGARFEQNLPKGEQAFQLYSLGTPNGVKVTILLEELLEAGFKEAAYDLYKIAIMDGDQFGSDFVKLNPNSKIPALLDQSGTEDVRVFESAHILLYLAEKFGAFLPSNPVEKVEVLNWLFWQAGAAPFLGGGFGHFFNYAPEKLEYPINRFTMEVKRQLDLLDKELAQKPYIAGNDYTIADIAIWSWYGQLVQGNLYQGSAKFLDASSYQNLVKWAEKIANRPAVKRGLEVTYTEII

SEQ ID NO: 4124 - protein, 445 aa, Streptococcus pneumoniae
  misc_feature (B) LOCATION 1...445
  hypothetical: YES
DFIFVYNFSYSCYNQPIGIKEVTLMAVFVSLDGIVVEVLDVFSSFNGDSEFFLCKRLKDKSQFVMERSQFEEMFQLQSSRLTTQEKLQLFTSVFAGRYDVYAKSFINDQGKIQYFPSYDCGWKQLLPEKRSFQTLTDSVLKSHFRGETAIGIFPMHLDDSCHFLVLDFDEGDWKEAGLTIRRIARERQMEAHLEISRSGHGLHIWFFFEEAIPSREARLFGKKLIELAMQESMQLSFDSFDRMFPNQDVLPKGGFGNLIALPFQGEAYHQVRTVFVDEHFQPYGDQWRYLQGIQKISTAKVALLIQEELGKQELDKELKVVLSNMIQLKKSSVTPKTLFFLKNMASFSNPEFYLKQAMRQPTYQIPERMYLFGESDYYLWLPRGLLYPLQDKFKQVVVEDRRKVQRSIRVAFKGELTLEQELALSDMNSKENGLLHAGQVLERAF

SEQ ID NO: 4125 - protein, 295 aa, Streptococcus pneumoniae
  misc_feature (B) LOCATION 1...295
  hypothetical: YES
CALRNKGSVMAKTFFIPNKQSILGEQEILNAKSILALLDGLESHSYDVVYLRQPLNRLEYIECAIVGQSQFLFKVSYADGQKAYRVDLPDLLTKTDWQIIKSFLDALLAYTGTDIEGLDGFDFEAYFQASIQAYLADAVARFTICQGIFNPIFFSRENLKSFLEADGLAQFEARVRAVQETDAYFARVSFYQDGEGKVHGVYHLAQGVKTVLPREPFVPAAYIEQLVDKEVQWEIDLVQITGDGSKPEDYESIARLDYAKFLEVLPPSFYHQLDANQIEIHPILGQDFKTLAQEK

SEQ ID NO: 4126 - protein, 106 aa, Streptococcus pneumoniae
  misc_feature (B) LOCATION 1...106
  hypothetical: YES
GNLLMCEKIRIRRVSDYPSARGGLEDILIMENMTNHLLLVQIRVHGYLLDFASIEGQRQKHYRLKNLPQTVELTVDDVEEDVDLTLPENRSYQEADFFERMFRENC

SEQ ID NO: 4127 - protein, 295 aa, Streptococcus pneumoniae
  misc_feature (B) LOCATION 1...295
  hypothetical: YES
QLVRKVSEGADLISMKGDVITEHQFYEQVKNNPSAQQVLLNMTIQKVFEKQYGSELDDKEVDDTIAEEKKQYGENYQRVLSQAGMTLETRKAQIRTSKLVELAVKKVAEAELTDEAYKKAFDEYTPDVTAQIIRLNNEDKAKEVLEKAKAEGADFAQLAKDNSTDEKTKENGGEITFDSASTEVPEQVKKAAFALDVDGVSDVITATGTQAYSSQYYIVKLTKKTEKSSNIDDYKEKLKTVILTQKQNDSTFVQSIIGKELQAANIKVKDQAFQNIFTQYIGGGDSSSSSSTSNE

SEQ ID NO: 4128 - protein, 90 aa, Streptococcus pneumoniae
  misc_feature (B) LOCATION 1...90
  hypothetical: YES
WRSRSLGYLWSSSILEGYCRWNSTYRFWFGSWLFFRRRLTMMKDLNNYREISNKELQEIKGGFGVGVGIALFMAGYTIGKDLRKKFGKSC

SEQ ID NO: 4129 - protein, 84 aa, Streptococcus pneumoniae
  misc_feature (B) LOCATION 1...84
  hypothetical: YES
RSTRGEEHLRYFAFYLDYYLRTGVAGFEPTHEGVKVPCLTAWLYPINEMEREGFEPPNPKERIYSPPRLASSLSLLQSTWTIIS

SEQ ID NO: 4130 - protein, 172 aa, Streptococcus pneumoniae
  misc_feature (B) LOCATION 1...172
  hypothetical: YES
KQARIAEAAGAAAVMALERIPADIRAAGGVSRMSDPKMIKEIQEAVSIPVMAKVRIGHFVEAQILEAIEIDYIDESEVLSPADDRFHVDKKEFQVPFVCGAKDLGEALRRIAEGASMIRTKGEPGTGDIVQAVRHMRMMNQEIRRIQNLREDELYVAAKDFASPCRIGPICS

SEQ ID NO: 4131 - protein, 188 aa, Streptococcus pneumoniae
  misc_feature (B) LOCATION 1...188
  hypothetical: YES
SVYRSARRSLMDKKTVKVIEKYSMPFVQLVLEKGEEDRIFSDLTQIKQVVEKTGLPSFLKQVAVDESDKEKTIAFFQDSVSPLLQNFIQVLAYNHRANLFYDVLVDCLNRLEKETNRFEVTITSAHPLTDEQKTRLLPLIEKKMSLKVRSVKEQIDESLIGGFVIFANHKTIDVSIKQQLKVVKENLK

SEQ ID NO: 4132 - protein, 449 aa, Streptococcus pneumoniae
  misc_feature (B) LOCATION 1...449
  hypothetical: YES
SQHRGEDSASQLEKVLNIVKSDSERRFVVVSAPGKRNAEDTKVTDALIKYYRDYVAGNDISKSQSWIIDRYAAMVSELGLKPAVLEKISKSIHTLATLPIEENEFLYDTFLAAGENNNAKLIAAYFNQNGIDARYMHPREAGIVVTSEPGHARIIPSSYDKIEELTNTNEVLVIPGFFGVTKENQICTFSRGGSDITGSIIAAGVKADLYENFTDVDGIFAAHPGIIHQPHSIPELTYREMRELAYAGFSVLHDEALLPAYRGKIPLVIKNTNNPDHPGTRIVLKHSNDEFPVVGIAGDSGFVSINMSKYLMNREIGFGRKVLQILEELNIGWEHMPTGIDDLSIILRSRQLTPIKEEEILRQLVQKAKVDHAEIEHDLSIIMIVGEKMKSHIGVTATATRALSENKINIQMMSQGSSEVSIMFVVNKDQEKAAIKALYNAFFGESKED

SEQ ID NO: 4133 - protein, 346 aa, Streptococcus pneumoniae
  misc_feature (B) LOCATION 1...346
  hypothetical: YES
SENRGKKMQEKILVTGGAGFIGTHTVIELIQAGHQVVVVDNLVNSNRKSLEVVERITGVEIPFYEADIRDTDTLRDIFKQEEPTGVIHFAGLKAVGESTRIPLAYYDNNIAGTVSLLKAMEENNCKNIIFSSSATVYGDPHTVPILEDFPLSVTNPYGRTKLMLEEILTDIYKADSEWNVVLLRYFNPIGAHESGDLGENPNGIPNNLLPYVTQVAVGKLEQVQVFGDDYDTEDGTGVRDYIHVVDLAKGHVAALKKIQKGSGLNVYNLGTGKGYSVLEIIQNMEKAVGRPIPYRIVERRPGDIAACYSDPAKAKAELGWEAELDITQMCEDAWRWQSKHPNGFED

SEQ ID NO: 4134 - protein, 70 aa, Streptococcus pneumoniae
  misc_feature (B) LOCATION 1...70
  hypothetical: YES
MENRHMKHFFAGIGEIKLVGYLLYICVGLAPLFHIYVIGSELSFVKIVLSILGVIFVSMLTIARIYRTFL

SEQ ID NO: 4135 - protein, 72 aa, Streptococcus pneumoniae
  misc_feature (B) LOCATION 1...72
  hypothetical: YES
RLCRLDPIFQELSDLDDLNVLWYTIFVIGYRLRSYGFVRGGETNEPYHRARSYYYSGCYSWNYLVFRLQMAR

SEQ ID NO: 4136 - protein, 368 aa, Streptococcus pneumoniae
  misc_feature (B) LOCATION 1...368
  hypothetical: YES
PVRRSGWWAPFITTLVADGFNNVSDIIGNVALLIGIRMARQPADRDHRFGHWKIEDLASLITSIIMFYVGFDVLRDTIQKILSREETVIDPLGATLGIISAAIMFVVYLYNTRLSKKSNSKALKAAAKDNLSDAVTSLGTAIAILASSFNYPIVDKLVAIIITFFILKTAYDIFIESSFSLSDGFDDRLLEDYQKAIMEIPKISKVKSQRGRTYGSNIYLDITLEMNPDLSVFESHEIADQVESMLEERFGVFDTDVHIEPAPIPEDEILDNVYKKLLMREQLIDQGNQLEELLTDDFVYIRQDGEQMDKEAYKTKKELNSAIKDIQITSISQKTKLICYELDGIIHTSIWRRHETWQNIFHQETKKE

SEQ ID NO: 4137 - protein, 93 aa, Streptococcus pneumoniae
  misc_feature (B) LOCATION 1...93
  hypothetical: YES
TQLLQLLMEELLQGLFQVLPVLLNALKIENLVLGIIAIVYYKGDKRVGAAPSVLMIVSGGVSLIPFLGWVGGILAIIGGSLFLATLKKFKSEE

SEQ ID NO: 4138 - protein, 63 aa, Streptococcus pneumoniae
  misc_feature (B) LOCATION 1...63
  hypothetical: YES
AIMLVSQIQQVPTPYLLEVEVLAVASLEAEVAAVSEPFKESYHRLKKYDIMEDRRKTNYKKSQ

SEQ ID NO: 4139 - protein, 451 aa, Streptococcus pneumoniae
  misc_feature (B) LOCATION 1...451
  hypothetical: YES
EIMLDLLKQTIFTRDFIFILILLGFILVVTLLLLENRRDNIQLKQINQKVKDLIAGDYSKVLDMQGGSEITNITNNLNDLSEVIRLTQENLEQESKRLNSILFYMTDGVLATNRRGQIIMINDTAKKQLGLVKEDVLNRSILELLKIEENYELRDLITQSPELLLDSQDINGEYLNLRVRFALIRRESGFISGLVAVLHDTTEQEKEERERRLFVSNVSHELRTPLTSVKSYLEALDEGALCETVAPDFIKVSLDETNRMMRMVTDLLHLSRIDNATSHLDVELINFTAFITFILNRFDKMKGQEKEKKYELVRDYPINSIWMEIDTDKMTQVVDNILNNAIKYSPDGGKITVRMKTTEDQMILSISDHGLGIPKQDLPRIFDRFYRVDRARSRAQGGTGLGLSIAKEIIKQHKGFIWAKSEYGKGSTFTIVLPYDKDAVKEEVWEDEVED

SEQ ID NO: 4140 - protein, 98 aa, Streptococcus pneumoniae
  misc_feature (B) LOCATION 1...98
  hypothetical: YES
PSFRPGDTVRVHAKVVEGNRERIQIFEGVVIARKGAGISENYTVRKISNGVGVERIFPIHTPRVEKIEVVRYGKVRRAKLYYLRALQGKAARIKEIRR

SEQ ID NO: 4141 - protein, 242 aa, Streptococcus pneumoniae
  misc_feature (B) LOCATION 1...242
  hypothetical: YES
LPLRLGMAKQHKPWNFSIPCAFLTYISIVFGELYPKRIALNLKDALRIRTAPVIIGIGKLVSPFVWLLAASTNFLSHLTPMSFDDADEKMTRDEIAYMLTNSEETLDADEIEMLQGVFSLDELMAREVMVPRTDAFMVDIQDDSQAIIQSILKQNYSRIPVYDGDKDNVIGIIHTKSLLKAGFVDGFDNIVWKRILQDPLFVPETIFVDDLLXELRNTQRQMAILLDEYSGMAGLVTLGKLL

SEQ ID NO: 4142 - protein, 577 aa, Streptococcus pneumoniae
  misc_feature (B) LOCATION 1...577
  hypothetical: YES
QVIFKRTERGTMEKISLESAKRGSDLVLDTLRDLGVDTIFGYPGGAVLPFYDAIYNFKGIRHILGRHEQGCLHEAEGYAKSTGKLGVAVVTSGPGATNAITGIADAMSDSVPLLVFTGQVARRGLGKDAFQEADIVGITMPITKYNYQVRETADIPRIITEAVHIATTGRPGPVVIDLPKDISALETDFIYSPEVNLPSYQPTLEPNDMQIKKILKQLSKAKKPVLLAGGGISYAEAATELNEFAERYQIPVVTSLLGQGTIATSHPLFLGMGGMHGSFAANIAMTEADFMISIGSRFDDRLTGNPKTFAKNAKVAHIDIDPAEIGKIISADIPVVGDAKKALQMLLAEPTVHNNTEKWIEKVTKDKNRVRSYDKKERVVQPQAVIERIGELTNGDAIVVTDVGQHQMWTAQYYPYQNERQLVTSGGLGTMGFGIPAAIGAKIANPDKEVVLFVGDGGFQMTNQELAILNIYKVPIKVVMLNNHSLGMVRQWQESFYEGRTSESVFDTLPDFQLMAQAYGIKNYKFDNPETLAQDLEVITEDVPMLIEVDISRKEQVLPMVPAGKSNHEMLGVQFHA

SEQ ID NO: 4143 - protein, 324 aa, Streptococcus pneumoniae
  misc_feature (B) LOCATION 1...324
  hypothetical: YES
GTSRLVVKTTCNWPWPCRTCTSTAPSWGSRTCRRAAWLSAALATWMRPCTASSRRARSASGSGRLPLDASRRASRRSPGVCMAGNGTGAWSSGGSADGSVSPGCRRSSPRPSPPAVGAGGETWTLACAVDATSAAVFAGKPGPGCGRSCVRPAICGWEDTGTSGGSSTGGAETLAGSRACVDAATRAETAGACRATDPDGNTVGVGVGVGVGVGVGVGVGVASAATGTGACXLVGGRSAAGAAGWSARGVEVGASLFAAGSSASVVSSPLSNGGLGAGGRCAGRACSKAICCARSGGRGAGVSDDTSGAVSTAFSLSMARSRGG

SEQ ID NO: 4144 - protein, 96 aa, Streptococcus pneumoniae
  misc_feature (B) LOCATION 1...96
  hypothetical: YES
CLPRQFSGILAVAESYPDLKASANFVKLQEELTNTENKISYSRQLYNSVVSNYNVKLETFPSNIIAGMFGFKAADFLQTPEEEKSVPKVDFSGLGD

SEQ ID NO: 4145 - protein, 83 aa, Streptococcus pneumoniae
  misc_feature (B) LOCATION 1...83
  hypothetical: YES
ASPRASCRGSNANANANANANANANANANSVAVRIGSTASAGGFRARRGVHASPGAGQRFGASGRRTAAGAGVLPPANRRSDA

SEQ ID NO: 4146 - protein, 60 aa, Streptococcus pneumoniae
  misc_feature (B) LOCATION 1...60
  hypothetical: YES
LPPRGEEAAGYSKYSFEVANKTDEVSSKHCFEIVDRTDEVSNHTHGKATLTWFEEIFEEY

SEQ ID NO: 4147 - protein, 219 aa, Streptococcus pneumoniae
  misc_feature (B) LOCATION 1...219
  hypothetical: YES
TDYRLYIELLRNLADEAGLPKTLDTGSLAGIKTHEYCTNNQPNNHSDHVDPYPYLAKWGISAEQFKYDIENGLTIETGWQKNDTGYWYVHSDGSYPKDKFEKINGTWYYFDSSGYMLADRWRKHTDGNWYWFDNSGEMATGWKKIADKWYYFNEEGAMKTGWVKYKDTWYYLDAKEGAMVSNAFIQSADGTGWYYLKPDGTLADKPEFTVEPDGLITVK

SEQ ID NO: 4148 - protein, 186 aa, Streptococcus pneumoniae
  misc_feature (B) LOCATION 1...186
  hypothetical: YES
FLYRKLPQRYARYRRCXNLSQTQFQEGKTAAIIDGPWKAQAFKDAKVNYGVATIPILPNGKEYAAFGGGKAWFIPQAVKNLEASQKFVDFLVATEQQKVLYDKTNEIPANTEARSYAEGKNDELTTAVIKQFKNTQPLPNISQMSAVWDPAKNMLFDAVSGQKDAKTAANDAVTLIKETIKQKFGE

SEQ ID NO: 4149 - protein, 407 aa, Streptococcus pneumoniae
  misc_feature (B) LOCATION 1...407
  hypothetical: YES
EMYRYQIGIPTLEYDQFVKEHELANVLQSSAWEEVKSNWQHEKFGVYREEKLLATASILIRTLPLGYKMFYIPRGPILDYGDKELLNFAIQSIKSYARSKRAVFVTFDPSICLSQSLINQEKTEFPENLAIIDSLQQMGVRWSGKTEEMGDTIQPRIQAKIYKENFEEDKLSKSTKQAIRTARNKGLEIQYGGLELLDSFSELMKKTEKRKEIHLRNEAYYKKLLDNFKDKAYITLATLDVSKRSQELEEQLAKNRALEETFTESTRTSKVEAQKKEKERLLEELTFLQEYIDVGQARVPLAATLSLEFGTTSVNIYAGMDDDFKRYNAPILTWYETARYAFERGMVWQNLGGVENSLNGGLYHFKEKFNPTIEEYLGEFTMPTHPLYPLLRLALDFRKTLRKKHRK

SEQ ID NO: 4150 - protein, 287 aa, Streptococcus pneumoniae
  misc_feature (B) LOCATION 1...287
  hypothetical: YES
GGNRVSDAPRLNQPRIVGRGSFAYLVYCVKERRAVDNLYLVKDDSQLAAFRDFVVRNTEKLKDYQSFLKNELAVCDLPQAVIWSSFNAATQIIRESAVPAYTNNRRMVMTPDLAVWKELYLYQLMDYECSQQTQAIESHYHSLSENFLLQIVGHELAHWSEYFLDDFDGYDSYIWFEEGMVEYISRKYFLTEEEFQAEKICNQSLVELFQKKYGWHSLNDFGSSTYDKNYASIFYEYWRSFLTIDKLVENLGSVQAVFDSYHLWANTDKTLPLLNWFVQQKLIEKEI

SEQ ID NO: 4151 - protein, 256 aa, Streptococcus pneumoniae
  misc_feature (B) LOCATION 1...256
  hypothetical: YES
KGNRMTDAILQVSDLSVYYNKKKALNSVSLSFQPKEITALIGPSGSGKSTLLKSLNRMGDLNPEVTTTGSVVYNGHNIYSPRTDTVELRKEIGMVFQQPNPFPMTIYENVVYGLRINGIKDKQVLDEAVEKALQGASIWDEVKDRLYDSAIGLSGGQQQRVCVARVLATSPKIILLDEPTSALDPISAGKIEETLYGLKDKYTMLLVTRSMQQASRISDKTGFFLDGDLIEFNDTKQMFLDPQHKETEDYITGKFG

SEQ ID NO: 4152 - protein, 165 aa, Streptococcus pneumoniae
  misc_feature (B) LOCATION 1...165
  hypothetical: YES
FSIFLVSIAENDFYIGFYHSFQHSIISDFSIFFNFYFFSLPPPLFIGKYGKIEQTKNHHFTKGCKMKITQEEVTHVANLSKLRFSEEETAAFATTLSKIVDMVELLGEVDTTGVAPTTTMADRKTVLRPDVAEEGTNRDRLFKNVPEKDNYYIKVPAILDDGGDA

SEQ ID NO: 4153 - protein, 64 aa, Streptococcus pneumoniae
  misc_feature (B) LOCATION 1...64
  hypothetical: YES
EVSRRLLKAVFEVVDKTDEVSLKHCFEVADRTDEVSNHTYDKVKLTWFEEIFEEYHTKKPCSSR

SEQ ID NO: 4154 - protein, 65 aa, Streptococcus pneumoniae
  misc_feature (B) LOCATION 1...65
  hypothetical: YES
QGSRIGRCGWITSFLRIRNCALVLFSLERSCGALAQLGERLLCTQEVSGSIPLGSIGERSSSNAH

SEQ ID NO: 4155 - protein, 1653 aa, Streptococcus pneumoniae
  misc_feature (B) LOCATION 1...1653
  hypothetical: YES
KVLRIRKLSVGACSLMIGAVLFAGPALAEETAVPENSGANTELVSGESEHSTNEADKQNEGEHTRENKLEKAEGVATASETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHAFVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTSDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVQAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLRYQGHEFNFDVLVSPKAALNDEYLKQKLAEVEAAKNKVVYNFASPEVKAAFLKAIEAAEQVLKDHETSTQDQVNDRLNKLTEAHKALNGQEKFKEEKTELDRLTGEVQELLAAKPNHPSGSALAPLLEKNKALVEKVDLSPEELATAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNKVLPKPTYQPASDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDQRLNIEKSCEIFPYISKV

SEQ ID NO: 4156 - protein, 225 aa, Streptococcus pneumoniae
  misc_feature (B) LOCATION 1...225
  hypothetical: YES
KELRLSSMKEMLFVSSVLQVLVMYNXLRSLNLLEEVTSGHITVNGYDLTEKTTNVDHVRENIGMVFQHFNLFPHMSVLDNITFAPIVHKLMTKEEAEKLGMELLEKVGLADKANANPDSLSGGQKQRVAIARGLAMNPDIMLFDEPTSALDPEMVGDVLNVMKELAEQGMTMIIVTHEMGFARQVANRVIFTADGEFLEDGTPDQIFDNPQHPRLKEFLDKVLNV

SEQ ID NO: 4157 - protein, 218 aa, Streptococcus pneumoniae
  misc_feature (B) LOCATION 1...218
  hypothetical: YES
KMLRSQFEEDLEKLHNQFYAMGQEVLSQINRTVRAFVTHDRDLAKEVIEDDAEVNEYEVKLEKKSFEMIALQQPVSQDLRTVLTVLKAVSDVERMGDHAVAIAQATIRMKGEERIPAVEEEIKKMGREVKSVVEAALDLYLNGSVDDAYRVASMDEQINHYFETIRDLATEEIKKNPEAIVTGRDYFQVISYLERIGDYAKNICEWVVYFETGKIVEL

SEQ ID NO: 4158 - protein, 70 aa, Streptococcus pneumoniae
  misc_feature (B) LOCATION 1...70
  hypothetical: YES
KFIRPLLGILSCASQATAILLAKLPYTSAASTAIRKIHPKILVNNPTLAAAVAAALFKIERAILIPYLAA

SEQ ID NO: 4159 - protein, 288 aa, Streptococcus pneumoniae
  misc_feature (B) LOCATION 1...288
  hypothetical: YES
IMVRPIGIYEKATPTHFTWLERLNFAKELGFDFVEMSIDERDERLARLDWSKEERLEVVKAIYETGVRIPSICFSGHRRYPLGSKDPVLEEKSLELMKKCIELAQDLGVRTIQLAGYDVYYEEKSPQTRQRFIKNLRKACDWAEEAQVVLAIEIMDDPFISSIEKYLAIEKEIDSPFLFVYPDIGNVSAWHNDIYSEFYLGHHAIAALHLKDTYAVTESSKGQFRDVPFGQGCVKWEEAFDILKETNYNGPFLIEMWSENCETVEETRAAIQEAQAFLYPLIKKAGLM

SEQ ID NO: 4160 - protein, 156 aa, Streptococcus pneumoniae
  misc_feature (B) LOCATION 1...156
  hypothetical: YES
LVSLAPFNKKRKMLSKILRHLYSIKNSTIFSCRLESNNGSDADFDKVDALLDQLSANSKDKTALLESTKAILVLNHQIQSKASASEETSPARNAEANGDNTSAENQPNATAESNIETASDENKPSNTRDSKPAESTSENKTTESSTTTGNQEKPVE

SEQ ID NO: 4161 - protein, 260 aa, Streptococcus pneumoniae
  misc_feature (B) LOCATION 1...260
  hypothetical: YES
WQSLMQVENRLDLLHTITRKYGGTVDDVLLYFAKITEEYNLLTGNNLSSEDMEAELKKLEVNLVNLAGQLASARHNLAQQLEAEIKQELQDLYMEKAQFQVRFSKGKFSREGNEMVEFYISTNPGEDFKPLVKVASGGELSRLMLAIKSAFSRKEGKTSIVFDEVDTGVSGRVAQAIAQKIHKIGQYGQVLAISHLPQVIAIADYQFFIEKISNDHSTVSTVRLLTVEERVEEVAKMLAGDDVTEAALTQARELLRNREK

SEQ ID NO: 4162 - protein, 62 aa, Streptococcus pneumoniae
  misc_feature (B) LOCATION 1...62
  hypothetical: YES
SLARAACCILCVTMMMVKFFLSSNMVSSSCMVAIGSKAEAGSSIKRISGLTEMARAIQRRCC

SEQ ID NO: 4163 - protein, 160 aa, Streptococcus pneumoniae
  misc_feature (B) LOCATION 1...160
  hypothetical: YES
RTQRPKSPLETPHRPQCRTNRTGFERLYGRLILFENLCKPRHVALPYVWLLTSSVSSTTSKTCFELTSSVSSTTSKTCFELTSSVSSTTSKTCFELTSSVSSATSKQCFELTSSVLSTTSKQCFELTSSVLSATSKQCVAQPLTSRLVRSMVFIKSTSLV

SEQ ID NO: 4164 - protein, 1069 aa, Streptococcus pneumoniae
  misc_feature (B) LOCATION 1...1069
  hypothetical: YES
LCPLDALNILYMPKRTDIQKIMVIGSGPIIIGQAAEFDYAGTQACLSLKEEGYEVVLVNSNPATIMTDKEIADKVYIEPITLEFVTRILRKERPDALLPTLGGQTGLNMAMELSKNGILDELGVELLGTKLSAIDQAEDRDLFKQLMEELEQPIPESEIVNTVEEAIAFAATIGYPVIVRPAFTLGGTGGGMCANEKELREITENGLKLSPVTQCLIERSIAGFKEIEYEVMRDSADNALVVCNMENFDPVGIHTGDSIVFAPAQTMSDYENQMLRDASLSIIRALKIEGGCNVQLALDPNSFKYYVIEVNPRVSRSSALASKATGYPIAKLAAKIAVGLTLDEVINPVTGSTYAMFEPALDYVVAKIPRFPFDKFEKGERRLGTQMKATGEVMAIGRNIEESLLKACRSLEIGVHHNEIPELAAVSDDALIEKVVKAQDDRLFYVSEAIRRGYTPEEIAELTKIDIFYLDKLLHIFEIEQELGAHPQDLEVLKTAKLNGFSDRKIAELWGTTDDQVRQLRLENKIIPVYKMVDTCAAEFDSETPYFYSTYGWENESIRSDKESVLVLGSGPIRIGQGVEFDYATVHSVKAIQAAGYEAIIMNSNPETVSTDFSVSDKLYFEPLTFEDVMNVIDLEQPKGVIVQFGGQTAINLAEPLAKAGVTILGTQVADLDRAEDRDLFEQALKELDIPQPPGQTATNEEEAALAARKIGFPVLVRPSYVLGGRAMEIVENEEDLRSYMRTAVKASPDHPVLVDSYIVGQECEVDAISDGKNVLIPGIMEHIERAGVHSGDSMAVYPPQTLSQKVQETIADYTKRLAIGLHCLGMMNIQFVIKDEKVYVIEVNPRASRTVPFLSKVTNISMAQVATKLILGQSLSELGYQNGLYPESTRVHIKAPVFSFTKLAKVDSLLGPEMKSTGEVMGSDATLEKALYKAFEASYLHLPTFGNVVFTIADDAKEEALNLARRFQNIGYGILATEGTAAFFASHGLQAQPVGKIGDDDKDIPSFVRKGRIQAIINTVGTKRTADEDGEQIRRSAIEHGVPLFTALDTANAMLKVLESRSFVTEAI

SEQ ID NO: 4165 - protein, 385 aa, Streptococcus pneumoniae
  misc_feature (B) LOCATION 1...385
  hypothetical: YES
MQQRFRTILDNQGDLQNIGGLSYLVEIVNSVPTSANAEYYAKIVAEKAMLRRLIAKLTESVNQAYEASQPADEIIAQAEKGLIDVSENANRSGFKNIRDVLNLNFGNLEARSQQTTDITGIATGYRDLDHMTTGLHEEELIILAARPAVGKTAFALNIAQNIGTKLDKTVAIFSLEMGAESLVDRMLAAEGLVESHSIRTGQLTDEEWQKYTIAQGNLANASIYIDDTPGIRITEIRSRSRKLAQETGNLGLIVIDYLQLITGTGRENRQQEVSEISRQLKILAKELKVPVIALSQLSRGVEQRQDKRPVLSDIRESGSIEQDADIVAFLYRDDYYERGGEEEEGIPNNKVEVIIEKNRSGARGTVELIFQKEYNKFSSISKREA

SEQ ID NO: 4166 - protein, 285 aa, Streptococcus pneumoniae
  misc_feature (B) LOCATION 1...285
  hypothetical: YES
ITKRKETTMNHKIAILSDVHGNATALEAVIADAKNQGASEYWLLGDIFLPGPGANDLVALLKDLPITASVRGNWDDRVLEVLDGEYGLEYPKEIQSMRMTQFLMERMDPATIVWLRSLPLLEKKEIDGLRFSISHNLPDKNYGGDLLVENDTEKFDQLLDAETDVAVYGHVHKQLLRYGSQGQQIINPGSIGMPYFNWEALKNHRAQYAVIEVEDGELVNILFRKVAYDYEAELEFAKSKRLPFIEMYEELRREDNYQRHNLELLASLIEKHRYVEDVKNFFDFL

SEQ ID NO: 4167 - protein, 96 aa, Streptococcus pneumoniae
  misc_feature (B) LOCATION 1...96
  hypothetical: YES
LIPLERFVMRQMLLRKLVLLKSMQAVRTQFFLVLLRTISKNQLLRKWLFWIPSICQKSALIDKIEQISIAHLLGDAIVRIHEKRPLSPLFDIEKKI

SEQ ID NO: 4168 - protein, 149 aa, Streptococcus pneumoniae
  misc_feature (B) LOCATION 1...149
  hypothetical: YES
RIRRCFQSFGGKMTIYLTEKQIEKINALAIQRYSPNEKIQTVSSSALNMIVNLPEQFVFGKSLYPTIFDKATILFVQLIKKHVFANANKRTAFFVLVKFLQLNGYRFSVTVEEAVKMCVTIAVEALTDEKMTSYSKWVSEHSVREKVKK

SEQ ID NO: 4169 - protein, 406 aa, Streptococcus pneumoniae
  misc_feature (B) LOCATION 1...406
  hypothetical: YES
LKTLKKGYHVMTKTIAINAGSSSLKWQLYLMPEEKVLAKGLIERIGLKDSISTVKFDGRSEQQILDIENHTQAVKILLDDLIRFDIIKAYDEITGVGHRVVAGGEYFKQSTVVEGDVLEKVEELSLSAPLHNPANAAGVRAFKELLPDITSVVVFDTSFHTSMPEKAYRYPLPTKYYTENKVRKYGAHGTSHQFVAGEAAKLLGRPLEDLKLITCHIGNGGSITAVKAGKSVDTSMGFTPLGGIMMGTRTGDIDPAIIPYLMQYTEDFNTPEDISRVLNRESGLLGVSANSSDMRDIEAAVAEGNHEASLAYEMYVDRIQKHIGQYLAVLNGADAIVFTAGVGENAESFRRDVISGISWFGCDVDDEKNVFGVTGDISTEAAKIRVLVIPTDEELVIARDVERLKK

SEQ ID NO: 4170 - protein, 187 aa, Streptococcus pneumoniae
  misc_feature (B) LOCATION 1...187
  hypothetical: YES
GKLRKKVKKKTRMAIENYIPDFAVEAVYDLTVPSLQAQGIKAVLVDLDNTLIAWNNPDGTPEMKQWLHDLRDAGIGIIVVSNNTKKRVQRAVEKFGIDYVYWALKPFTFGIDRAMKEFHYDKKEVVMVGDQLMTDIRAAHRAGIRSILVKPLVQHDSIKTQINRTRERRVMRKITEKYGPITYKKGI

SEQ ID NO: 4171 - protein, 97 aa, Streptococcus pneumoniae
  misc_feature (B) LOCATION 1...97
  hypothetical: YES
RSMRFNFLHRYISPSLATSLVHKVIHRLWIINHDLTASSFQLQLVGSGFFSSIFPLQTALSYGSANTSQNATLHNYSQASFRSLCEDHSLSRLFHRL

SEQ ID NO: 4172 - protein, 182 aa, Streptococcus pneumoniae
  misc_feature (B) LOCATION 1...182
  hypothetical: YES
LLMRRKYKSIALKKELANYSGKKKCHAMKAQAIVTSQGRIVSLDITVNYCHDMKLFKMSRRNIGQAGKILTDSDYQGPMKIYPQAQTPRKASKLKPLTAEDKACNHALSKDRSKVENILAKVKTFKMFSTTYRNHRKRFGLRMNLIAGIINHELGFWFRRKSNVIFAIQDVSMTIQDLDEKF

SEQ ID NO: 4173 - protein, 340 aa, Streptococcus pneumoniae
  misc_feature (B) LOCATION 1...340
  hypothetical: YES
RASRQRPQKGNGKPFMRKPKITVIGGGTGIPVILKSLREKDVEIAAIVTVADDGGSSGELRKNMQQLTPPGDLRNVLVAMSDMPKFYEKVFQYRFSEDAGAFAGHPLGNLIIAGLSEMQGSTYNAMQLLSKFFHTTGKIYPSSDHPLTLHAVFQDGTEVAGESHIVDHRGIIDNVYVTNALNDDTPLASRRVVQTILESDMIVLGPGSLFTSILPNIVIKEIGRALLETKAEIAYVCNIMTQRGETEHFTDSDHVEVLHRHLGRPFIDTVLVNIEKVPQEYMNSNRFDEYLVQVEHDFVGLCKQVSRVISSNFLRLENGGAFHDGDLIVDELMRIIQVKK

SEQ ID NO: 4174 - protein, 91 aa, Streptococcus pneumoniae
  misc_feature (B) LOCATION 1...91
  hypothetical: YES
YSKRVITRYLSFMELLLYTISKVKLLEDILMPQPIVPVEIPQSRLFDSKKRNDILLKIRIGKLEVSFFQSLNLEMVEQLLDKVLLYDNSSI

SEQ ID NO: 4175 - protein, 142 aa, Streptococcus pneumoniae
  misc_feature (B) LOCATION 1...142
  hypothetical: YES
HGKRRRFPRASRRPRKPGSRPAFRRLRSTNRRWCRCPPTRKSQVGRMSGHSPAPASRRKPQPRSRPRRRPVSRSRRPRRQRAAKAAERSVGNPEKPIHPHCPPTTKRLCHCLPCKPPATACWHACWHRAGAGHCRWPISRAC

SEQ ID NO: 4176 - protein, 215 aa, Streptococcus pneumoniae
  misc_feature (B) LOCATION 1...215
  hypothetical: YES
FHWRSRGVKLNSDFVATSIAEYIRDQGRRVLLLMDSLTRFARAQREIGLAAGEPPTRRGYPPSVFAALPRLMERAGQSERGSITALYTVLVEGDDMSEPVADETRSILDGHIVLSRKLAAANHYPAIDVLHSVSRVMNQIVDDDQRHAAGRLREWLAKYEEVELLLKIGEYQKGQDSEADQAIEKIAAIRQWLRQGTHETSDYAQACAQLRSLCA

SEQ ID NO: 4177 - protein, 120 aa, Streptococcus pneumoniae
  misc_feature (B) LOCATION 1...120
  hypothetical: YES
LDWRERVVDSGHHIRFQNRCYIPTEQGKEVYFIRKTKALVIKAFDGDIYLNIADKIYHTKELLNHELYSKNFEQEPEQKKERRKYIPPQTHPWKLTSFKQYLHKNKKDYEEFKGGFFSTC

SEQ ID NO: 4178 - protein, 83 aa, Streptococcus pneumoniae
  misc_feature (B) LOCATION 1...83
  hypothetical: YES
TLRRLPLRPYTSCKIRWRVRGDDMSLLLRRHYIQEEQVNQYSDLENKTLEELKDLAKEAGVAGAYKLTKAEIVEVLEELKSEI

SEQ ID NO: 4179 - protein, 63 aa, Streptococcus pneumoniae
  misc_feature (B) LOCATION 1...63
  hypothetical: YES
FRGRVNSSRDPPTFHELRSLSARLYEKQISDKFAQHLLGHKSDTMASQYRDDRGREWDKIEIK

SEQ ID NO: 4180 - protein, 77 aa, Streptococcus pneumoniae
  misc_feature (B) LOCATION 1...77
  hypothetical: YES
AKGRITGIQPYGAFVELETGDTGLIHISEIRTGFIENIHETLKVDEEVQVQVVDLDEFTGESQSFYPHFGGRKVPVS

SEQ ID NO: 4181 - protein, 307 aa, Streptococcus pneumoniae
  misc_feature (B) LOCATION 1...307
  hypothetical: YES
YNIFNKILLFVNFFHEKEKIMRYDFGKVYKEIRESKGLTQEEVCGGVLSRTSLSKIESGKTTPKYENMEFLLRQINMSFEEFEYICQLYQPSQRTEIMQTYLNMRSIIGTSDLVNLFQKCQDYLKTHHDLPIEEIRDMLEVVIYLRQHGAGELSKHAEQVVKKLWKKIEKQDTWYESDLKILNTILFSFPIEYLHLITGKILQRLEVYKNYQHLYDLRMTILLNLSTLYLYNQDKNMCKQICYTLLEDAKNKKSYDRLAICYVRIGICTDDSKLIQKGFSLLELTEETSMLSHLKKEVEIYYQAKER

SEQ ID NO: 4182 - protein, 133 aa, Streptococcus pneumoniae
  misc_feature (B) LOCATION 1...133
  hypothetical: YES
MSQLLLVEKLEVHDEESYQELYRSHVQVVRLQTCHNLYFHQFLLYLVFQTRSFSYSLLNEKQCNAMIIHGDVLEDEHHCVGTGVTSRIAVTSRPAAASARIADSRPEPGPFTVTSTDLRPCSCADLAAASEAI

SEQ ID NO: 4183 - protein, 65 aa, Streptococcus pneumoniae
  misc_feature (B) LOCATION 1...65
  hypothetical: YES
KNKLVRITLILAKNYRNEWFFLMKQRKELYLFLGRTALYFLIFLGLLYFFSYLGQGQGSFIYNEF

SEQ ID NO: 4184 - protein, 505 aa, Streptococcus pneumoniae
  misc_feature (B) LOCATION 1...505
  hypothetical: YES
RVKLKKKEMRKLRMSNWDTKFLKKGFTFDDVLLIPAESHVLPNDADLTTKLADNLTLNIPIITAAMDTVTESQMAIAIARAGGLGVIHKNMSIAQQADEVRKVKRSENGVIIDPFFLTPEHTIAEADELMGRYRISGVPVVETLENRKLVGILTNRDLRFISDYNQPISNHMTSENLVTAPVGTDLATAESILQEHRIEKLPLVDEEGSLSGLITIKDIEKVIEFPNAAKDEFGRLLVAGAVGVTSDTFERAEALFEAGADAIVIDTAHGHSAGVLRKIAEIRAHFPDRTLIAGNIATAEGARALYEAGVDVVKVGIGPGSICTTRVIAGVGVPQVTAIYDAAAVAREYGKTIIADGGIKYSGDIVKALAAGGNAVMLGSMFAGTDEAPGETEIFQGRKFKTYRGMGSIAAMKKGSSDRYFQGSVNEANKLVPEGIEGRVAYKGAAADIVFQMIGGIRSGMGYCGAANLKELHDNAQFIEMSGAGLKESHPHDVQITNEAPNYSM

SEQ ID NO: 4185 - protein, 75 aa, Streptococcus pneumoniae
  misc_feature (B) LOCATION 1...75
  hypothetical: YES
SFFSKWKSERHARTNLDNRWWLVFEVGGVGWKSKITLGSTVFALKMESYFVLKKREALINIGMIYLEAVSNLVKD

SEQ ID NO: 4186 - protein, 161 aa, Streptococcus pneumoniae
  misc_feature (B) LOCATION 1...161
  hypothetical: YES
RYFRRVLMIDKVVRNLLLTFFFCKMTKIINFLTTILVKKKKMCYNVSKLREKKKGAMMWVLGFILFLIFFYSNDSKKIKKLEKKIKRLERKEKGNAEMSRLLQEMIGKEPIITGVYIGPDNWEVVDVDEEWVKLRRVDNTGKEKFKLQRIEDIQTVEFDGE

SEQ ID NO: 4187 - protein, 429 aa, Streptococcus pneumoniae
  misc_feature (B) LOCATION 1...429
  hypothetical: YES
GHFRRRGRKKMSRLLVIGCGGVAQVAISKICQDSETFTEIMIASRTKSKCDDLKAKLEGKTSTKIETAALDADKVEEVIALIESYKPEAVLNVALPYQDLTIMDACLATGVHYIDTANYEAEDTEDPEWRAIYEKRCKELGFTAYFDYSWQWAYQEKFKEAGLTALLGSGFDPGVTSVFSAYALKHYFDEIHYIDILDCNGGDHGYPFATNFNPEINLREVSAPGSYWEDGKWVEVEAMSIKREYDFPQVGQKDMYLLHHEEIESLAKNIPGVKRIRFFMTFGQSYLTHMKCLENVGLLRTDTINFNGQEIVPIQFLKALLPDPASLGPRTVGKTNIGCIFTGVKDGVEKTIYIYNVCDHQECYAEVGSQAISYTTGVPAMIGTKLVMNGTWKQAGVYNLEELDPDPFMEALNEYGLPWVVVENPQMVD

SEQ ID NO: 4188 - protein, 98 aa, Streptococcus pneumoniae
  misc_feature (B) LOCATION 1...98
  hypothetical: YES
NDFSTRKKLFSQVIVRTKHIHRNDFHLTTNGSIVAKKVISDDSLCSAFKNSDNIKIIKILRNETHLSLSEGILIPRHNLWKPRKIMLKVKVIELANDS

SEQ ID NO: 4189 - protein, 285 aa, Streptococcus pneumoniae
  misc_feature (B) LOCATION 1...285
  hypothetical: YES
GWKLYSNLLFWEKRMKFLTLNTHSWMEKEAEEKFQILLEDILEKDYDLICFQEINQEMTSSEVEVNDLYQALPAAEPIHQDHYVRLLVEKLLEQGKNYYWTWAYNHIGYDRYHEGVAILSKTPIEAREILVSDVDDPTDYHTRRVALAETVVDGKELAVASVHLSWWDKGFQEEWARFEAVLKKLNKPLLLAGDFNNPAGQEGYQAILASPLDLQDAFEVAQEKSGSYTVPPEIDGWKGNTEPLRIDYVFTTKELAVENLHVVFDGNKSPQVSDHYGLNAMLNWK

SEQ ID NO: 4190 - protein, 83 aa, Streptococcus pneumoniae
  misc_feature (B) LOCATION 1...83
  hypothetical: YES
QRKLFKIFHLFQKKSGWNQKSSCLKLNLNSLNRKMTQMTKMFRSIFQPKKPLNTNFQAYNSLHQINQKISLKRRKLSEKISKS

SEQ ID NO: 4191 - protein, 247 aa, Streptococcus pneumoniae
  misc_feature (B) LOCATION 1...247
  hypothetical: YES
NRIRIIKKVGSLLETIVFLISVFLAGVLSFFSPCIFPLLPVYAGILLDDQESAKSFSLFGRKVLWSGLIRTLCFIAGISLIFFILGFGAGYFGHILYANWFRYGMGAIIIILGLHQMEIFHLKKLEVQKSFTFKKSDSNRYWSAFLLGITFSFGWTPCIGPVLSSVLALAASGGNGAWQGAIYTLIYTLGMALPFLVLALASGLVMPYFSKIKRHMMLLKKIGGFLIVLMGILLLLGQVNVLAGIFE

SEQ ID NO: 4192 - protein, 409 aa, Streptococcus pneumoniae
  misc_feature (B) LOCATION 1...409
  hypothetical: YES
RRVRSDCCRVSRLPFTCMMRKGIVRRQKPSTKLFRGNKGFKEYFAVKATPTPAILKILQEEGCGVDCSSYVELLMSHKLDFLGSEIMFSSNNTPDKEYAYARELGATINLDAFEDIEHLERAAGIPEIISCRYNPGGVFELGTDIMDNPGEAKFGMTKDQLFEAFAILKEKGAKTFGIHSFLASNTVTHLYYPELARQLFELAVEIKEKLGIWLDFINLSGGIGVNYRPDQEPNDIALIGEGVRKVYEEVLTSAGLGQVKIFTELGRFMLAPHGALVTRVTHKKETYRTYLGVDASAVNLMRPAMYGAYHHISNVTHPDGPAEAVDVVGSLCENNDKFAVNRELPHTEIGDLLVIHDTGAHGFSMGYQYNAKLRSAEILYTEEGKARQIRRAERPEDYFATLYGFDFEE

SEQ ID NO: 4193 - protein, 720 aa, Streptococcus pneumoniae
  misc_feature (B) LOCATION 1...720
  hypothetical: YES
MGVRIENNLFYVESKNLSLIIENRNGYLLLKHLGKTIKNYKGSNSVYERDHAFSGNPTATNRTFSLDTQRQIFGQHGLGDFRKPTIQVQHSVTEVTDFRFVEAKILKGQNGPQGLPSPHSMDDTETLVLMLEDSKAQLSLTLYYTTFNNDATIASYSKLDNNSNQEVVIHKDFSFMADFPAADYEIVTLQGAYAREKTVRRQQVEQGIFSISSNRGASGHAQTPALLLCEQGVTEDAGNVFAIQLMYSGNFEAFVQKNQLNEVRVAIGINPENFSWKLAPEEYFETPVALVTHSDQGLTGISHESQNFVLKHIILSEFSKKERPILINNWEATYFDFQREKLLELADEAKKVGIELFVLDDGWFGNRFDDNRALGDWVVNEEKLGGSLESLISAIHERGLQFGLWLEPEMISVDSDLYRQHPDWAIQVPDYEHTYSRNQLVLNLANPQVVEYLKSVLDQLLSYHEIDYIKWDMNRNITKLGNGLTYLETQMQSHQYMLGLYELVSYLTEKHSHILFESCSGGGGRNDLGMMRYFPQVWASDNTDAIARLPIQYGSSYLYPTISMGAHVSAVPNHQMGRTTPLETRGHVAMMGNLGYELDLTSLSDEEKAEIANQVNLYKELRPVVQLGQQYRLINPDTASNEAAVQFNYKNQTIVTYVRVLSVVETMETTLKLKDLDEEGLYELQENGEVYSGAELMYAGLTVILSQGDFLSKQYIFRRL

SEQ ID NO: 4194 - protein, 84 aa, Streptococcus pneumoniae
  misc_feature (B) LOCATION 1...84
  hypothetical: YES
ACSSGLKLTLSEFGNNIQAHFFSDCKQFINKIYTLRKSLQTTSASPCRRYMILTLSVLSTTSKQCFEQPAASFLVCSLIFIEYK

SEQ ID NO: 4195 - protein, 167 aa, Streptococcus pneumoniae
  misc_feature (B) LOCATION 1...167
  hypothetical: YES
TVSRKGKIMIKELYEEVQGTVYKCRNEYYLHLWELSDWDQEGMLCLHELISREEGLADDIPRLRKYFKTKFRNRILDYIRKQESQKRRYDKEPYEEVGEISHRISEGGLWLDDYYLFHETLRDYRNKQSKEKQEELERVLSNERFRGRQRVLRDLRIVFKEFTIRTH

SEQ ID NO: 4196 - protein, 212 aa, Streptococcus pneumoniae
  misc_feature (B) LOCATION 1...212
  hypothetical: YES
NIPRSCFDLPNLFMQILCYFTITVVANPNNSGEVHLDVSIEDNQGGSGYNFSSVSSSSQTAKYEGAGYNNNSSLYITIDKTSDATALLKLKLNNVNNQPATEVPSSGITVKLNAKDNAGNWTSASNKKEVTVKIVSAKPTYPDKILVKNPDNIKDTEKNAIIEKLKEANKNHPAGAPTFAKGEGEHANDIVATYSDGTTYYVPLNDVTKYAR

SEQ ID NO: 4197 - protein, 205 aa, Streptococcus pneumoniae
  misc_feature (B) LOCATION 1...205
  hypothetical: YES
TDPRNSLEVTMELNTHNAEILLSAANKSHYPQDELPEIALAGRSNVGKSSFINTMLNRKNLARTSGKPGKTQLLNFFNIDDKMRFVDVPGYGYARVSKKEREKWGCMIEEYLTTRENLRAVVSLVDLRHDPSADDVQMYEFLKYYEIPVIIVATKADKIPRGKWNKHESAIKKKLNFDPSDDFILFSSVSKAGMDEAWDAILEKL

SEQ ID NO: 4198 - protein, 73 aa, Streptococcus pneumoniae
  misc_feature (B) LOCATION 1...73
  hypothetical: YES
TLPRIKPFTSCWSIRFTLSIYNSEGFPSLFDRFLYSMKIKEQTRKLAAGCSKHCFEVVDKTDEVSHIYNPRRR

SEQ ID NO: 4199 - protein, 157 aa, Streptococcus pneumoniae
  misc_feature (B) LOCATION 1...157
  hypothetical: YES
PLPRLGKYRGLGRRDLCYLDKISEKDGVGESQLLLMRMIVGHGIDIEELASIESAVTRHEGFAKRVLTAQEMERFTSLKGRRQIEYLAGRWSAKEAFSKAMGTGISKLGFQDLEVLNNERGAPYFSQAPFSGKIWLSISHTDQFVTASVILEENHES

SEQ ID NO: 4200 - protein, 219 aa, Streptococcus pneumoniae
  misc_feature (B) LOCATION 1...219
  hypothetical: YES
IKPRRPSYGHSSYVREYRTYEQIAADFGIHESNFIRRSQWVEVTLVQSGVTXQALLSALRTRYDMMRRKYKSIAIKKELANDSGKKKCHAMKAQAIVTSQGRIVSLDITVNYCHDMKLFKMSCRNIGQAGKILADSGYQGLMKIYPQVQTPRKSSKLKSLIAEDKAYNHALSKERSKVENIFAKVKTFKMFSTTYRNHRKRFGLRMNLSAGIINHELGF

SEQ ID NO: 4201 - protein, 97 aa, Streptococcus pneumoniae
  misc_feature (B) LOCATION 1...97
  hypothetical: YES
PEPRNEKARVPKALERPILQGFSVKLVHDLDSYSVHSSAQMLDNVEAVKNNLRLWKELLSEPIIRAVHVHGDDLDQLPNLSLIALEMVSNHRMSSPV

SEQ ID NO: 4202 - protein, 271 aa, Streptococcus pneumoniae
  misc_feature (B) LOCATION 1...271
  hypothetical: YES
TVARNVEVLTMYQDLLRKIAEEKPNYNQEEIQWLFDHLGNPSPEIRDDLIFTSFAKGIQEELFIQEQFHFIAEGVSSDVGLDKEIDKVGLPTLERSFRALVYANLLSADANQQSVFYQGLQSEIRDDLSNQGLHYLSKEKDTTGFSSQYGWVHSFAHGADLLTEVVCHPDFPKNRVHEVFDILGQLFKRMSIRFTDDEDWRLARVIYEPILQGKLEQEQVASWIKTVDFPIEEREDFSKFSNFRSCLVEVYVQLDQRNSLQDELKEAIQSX

SEQ ID NO: 4203 - protein, 69 aa, Streptococcus pneumoniae
  misc_feature (B) LOCATION 1...69
  hypothetical: YES
RNARRLLDDSYQEGLIFTATYAVGIGPFYISKFYFKIGYQERLLFTVKYKRVIYRILLHQDKYFLMVKF

SEQ ID NO: 4204 - protein, 251 aa, Streptococcus pneumoniae
  misc_feature (B) LOCATION 1...251
  hypothetical: YES
LEASMQQYFVKGSAISPVTIEDKETSKHMFQVMRLKEEDEVTLVFDDGIKRLARVLDMENRQFELVQELNDNVELPVQVTIASGFPKGDKLEFIAQKVTELGASQIWAFPADWSVAKWDGKKLGKKVEKLEKIALGAAEQSKRNIVPSIKLFEKKADFLAQLDQFDSIIVAYEESAKEGEAAALLQAVTGLETGAKLLFIFGPEGGLSPAEIESFEAKGAVLAGLGPRILRAETAPLYALSALSVLVELEK

SEQ ID NO: 4205 - protein, 76 aa, Streptococcus pneumoniae
  misc_feature (B) LOCATION 1...76
  hypothetical: YES
IQELLNTTMQELKKTEQLNNSILIDLEKFYQPTSPLIGLGSLKLNNQARTAWRNYDKIHYEHVKHVLSFYGPVFGF

SEQ ID NO: 4206 - protein, 566 aa, Streptococcus pneumoniae
  misc_feature (B) LOCATION 1...566
  hypothetical: YES
IFYRRSFMDKLVAAIEKQQGKFEKISTNNYMMAIKDGFIATMPLIMFSSFLMIIIMIPKNFGVELPSPAIVWMRKVYMLTMGVLGIIVSGTVGKSLVGNVNRKMPHGKVINDTSAMLAAICSYLVLTVTLVVDEKTGSTSLSTNYLGSQGLITSFVSAFITVNVYRFCIKRDITIHLPKEVPGAISQAFRDIFPFSFVLLISGLLDIVSRFSLDVPFAQVFQQLLTPIFKGAESYPAMMLIWFMCALLWFVGIHGPSIVLPAVTALQLSNMEENAQLLANGQFPYHSLTPNFGNYIAAIGGTGATFVVPFILIFFMRSKQLKSVGKATITPVLFAVNEPLLFGMPVILNPYLFVPFLMTPPVNVFLGKVFIDFFGMNGFYIQLPWAFPGPLGLLIGTNFQPISFVLLSLMLVVDILIYLPFCRAYDRQLLMKEDVASSNDIILEEDTSEIMPGEIDVIKSKELKVLVLCAGSGTSAQLANAINEGAQLAEVRVIANSGAYGAHYDIMGVYDLIILAPQVRSYYREMKVDAERLGIQIVATRGMEYIHLTKSPSKSLQFVLEHYQAV

SEQ ID NO: 4207 - protein, 282 aa, Streptococcus pneumoniae
  misc_feature (B) LOCATION 1...282
  hypothetical: YES
FLYRCLEVRLPNRVIFQKSTMRNTKKLRQFGIFLLIILLSTYLPQTIRLYVTIILGLGADVYSLILTMGLVGSFLLLIWRLKKKKMLFIFEKKSWNWSFVFYLFATYVVYQILGNFWARYAHLINHRNIHDEYFTVVLSNGQPTFLSTILSFVLPVIIDPVFEETLDRGYFMNTFFPKSKYYLDVILSGLIFGLSHLILSHRDPISLLYYSLIGFFFALVYRSTDNLRLTILCHSFLTFSIMQNLSGFLFTIISIIIFLDSGRQRKKCLISIKHFFFLLLAL

SEQ ID NO: 4208 - protein, 81 aa, Streptococcus pneumoniae
  misc_feature (B) LOCATION 1...81
  hypothetical: YES
TTYRTGLTNRNINSIGSVIPVIKDVKATPKNKPAYFLRRFLGTLWYIAKQAAGKPNIIVEKRPAKNLVPSVNNPEWAGSAN

SEQ ID NO: 4209 - protein, 67 aa, Streptococcus pneumoniae
  misc_feature (B) LOCATION 1...67
  hypothetical: YES
KAYRVAGVKSSCLAFLTYSHIYQVLFLPKLSIKRWHFLGLVLVNFALSYLSHFELFMVQWKHVIQII

SEQ ID NO: 4210 - protein, 227 aa, Streptococcus pneumoniae
  misc_feature (B) LOCATION 1...227
  hypothetical: YES
KQYRRKSMSDLKKYEGVIPAFYACYDDQGEVSPERTRALVQYFIDKGVQGLYVNGSSGECIYQSVEDRKLILEEVMAVAKGKLTIIAHVACNNTKDSMELARHAESLGVDAIATIPPIYFRLPEYSVAKYWNDISSAAPNTDYVIYNIPQLAGVALTPSLYTEMLKNPRVIGVKNSSMPVQDIQTFVSLGGEDHIVFNGPDEQFLGRRLMGARVVSVVLMVLCQNSS

SEQ ID NO: 4211 - protein, 574 aa, Streptococcus pneumoniae
  misc_feature (B) LOCATION 1...574
  hypothetical: YES
GMHRKTVIDFRTLGERYTFTKPIKELKTRNVEEVADLLAQVESYQEQGYYVVGYVSYEAAPAFEEKLAVHKDPLLGEYLLYFTVHDSVETSSIPLTYEDIDLPSNWQEVTSAADYEKAIAQIHHHLRQGDTYQVNYTVQLKQKLNANPFAIYNRMVVEQEAGYNAYVEHDEMAVISMSPELFFEQNDRELTTRPMKGTTQRGVTDQEDLEQASWLEQDPKNRSENMMIVDLLRNDMNRISEVGSEHVERLCQVEQYSTVWQMTSTIKSQLREDVDLVEIFRSLFPCGSITGAPKIATMEIIKDLEPQPRGVYCGTIGLLLPNGRRIFNVAIRTIQLHKGQAIYGVGGGITWDSTWESEYREVHQKAAVLYRKQARFQLITTGEISQKNLLFEDQHLERLRKASRYFAFPFDAEDLGHKIEEECQDCEANRDYRLRISLSKSGEIEVNRQVLTPLSTSFCQAQVCLQEAALNQSFTYFKTTHRPHLSLGEQEKIYHNKSGELLETSIGNLVLKIAGKLYTPPIRLGILPGIYRQYLLETGQVEEKVLTLADLAQAEAIYGCNAVRGLYELQVIGL

SEQ ID NO: 4212 - protein, 74 aa, Streptococcus pneumoniae
  misc_feature (B) LOCATION 1...74
  hypothetical: YES
DSILKRKDYKSSFPSHLFYRDLSLYSLEIKKQHTLSSFYRKPVNEGLVLSAISNQCFELNGTRFLVCSLILIGP

SEQ ID NO: 4213 - protein, 396 aa, Streptococcus pneumoniae
  misc_feature (B) LOCATION 1...396
  hypothetical: YES
ENNRKEVFMEQKEKHFSLSWFFKWFLDNKAITVFLVTLLLGLNLFILSKISFLFSPVLDFLAVVMLPVILSGLLYYLLNPIVDWMEKHKVNRVIAITIVFVIIALFIIWGLAVAIPNLQRQVLTFARNVPVYLEDIDRIVNGLVAQHLPDDFRPQLEQVLTNFSSQATVLASKVSSQAVNWVSAFISGASQVIVALIIVPFMLFYLLRDGKGLRNYLTQFIPRKLKEPVGQVLSDVNQQLSNYVRGQVTVAIIVAVMFIIFFKIIGLRYAVTLGVTAGILNLVPYLGSFLAMLPALVLGLIAGPVMLLKVVIVFIVEQTIEGRFVSPLILGSQLNIHPINVLFVLLTSGSMFGIWGVLLGIPVYASAKVVISAIFEWYKVVSGLYELEGEEVKSEQ

SEQ ID NO: 4214 - protein, 1463 aa, Streptococcus pneumoniae
  misc_feature (B) LOCATION 1...1463
  hypothetical: YES
MSNSFEILMNQLGMPAEMRQAPALAQANIERVVVHKISKVWEFHFVFSNILPIEIFLELKKGLSEEFSKTGNKAVFEIKARSQEFSNQLLQSYYREAFSEGPCASQGFKSLYQNLQVRAEGNQLFIEGSEAIDKEHFKKNHLPNLAKQLEKFGFPTFNCQVEKNDVLTQEQEEAFHAENEQIVQAANEEALRAMEQLEQMAPPPAEEKPVFDFQAKKAAAKPKLDKAEITPMIEVTTEENRLVFEGVVFDVEQKVTRTGRVLINFKMTDYTSSFSMQKWVKNEEEAQKFDLIKKNSWLRVRGNVEMNNFTRDLTMNVQDLQEVVHYERKDLMPEGERRVEFHAHTNMSTMDALPEVEEIVATAAKWGHKAVAITDHGNVQSFPHGYKAAKKAGIQLIYGMEANIVEDRVPIVYNEVEMDLSEATYVVFDVETTGLSAIYNDLIQVAASKMYKGNVIAEFDEFINPGHPLSAFTTELTGITDDHVKNAKPLEQVLQEFQEFCKDTVLVAHNATFDVGFMNANYERHDLPKISQPVIDTLEFARNLYPEYKRHGLGPLTKRFGVALEHHHMANYDAEATGRLLFIFIKEVAEKHGVTDLARLNIDLISPDSYKKARIKHATIYVKNQVGLKNIFKLVSLSNTKYFEGVPRIPRTVLDAHREGLILGSACSEGEVFDVVVSQGVDAAVEVAKYYDFIEVMPPAIYAPLIAKEQVKDMEELQTIIKSLIEVGDRLGKPVLATGNVHYIEPEEEIYREIIVRSLGQGAMINRTIGHGEHAQPAPLPKAHFRTTNEMLDEFAFLGEELARKLVIENTNALAEIFEPVEVVKGDLYTPFIDKAEETVAELTYKKAFEIYGNPLPDIVDLRIEKELTSILGNGFAVIYLASQMLVQRSNERGYLVGSRGSVGSSFVATMIGITEVNPLSPHYVCGQCQYSEFITDGSYGSGFDMPHKDCPNCGHKLSKNGQDIPFETFLGFDGDKVPDIDLNFSGEDQPSAHLDVRDIFGEEYAFRAGTVGTVAAKTAYGFVKGYERDYGKFYRDAEVERLAQGAAGVKRTTGQHPGGIVVIPNYMDVYDFTPVQYPADDVTAEWQTTHFNFHDIDENVLKLDVLGHDDPTMIRKLQDLSGIDPNKIPMDDEGVMALFSGTDVLGVTPEQIGTPTGMLGIPEFGTNFVRGMVDETHPTTFAELLQLSGLSHGTDVWLGNAQDLIKQGIADLSTVIGCRDDIMVYLMHAGLEPKMAFTIMERVRKGLWLKISEEERNGYIEAMKANKVPEWYIESCGKIKYMFPKAHAAAYVMMALRVAYFKVHHPIYYYCAYFSIRAKAFDIKTMGAGLEAIKRRMEEISEKRKNNEASNVEIDLYTTLEIVNEMWERGFKFGKLDLYRSQATEFLIDGDTLIPPFVAMDGLGENVAKQLVRAREEGEFLSKTELRKRGGLSSTLVEKMDEMGILGNMPEDNQLSLFDELF

SEQ ID NO: 4215 - protein, 217 aa, Streptococcus pneumoniae
  misc_feature (B) LOCATION 1...217
  hypothetical: YES
KENRMIELKNISKKFGSRQLFSDTNLHFEGGKIYALIGTSGCGKTTFLNMIGRLEPYDKGQIIYDGTSLKDIKPSVFFRDYLGYLFQDFGLIENQTVKENLNLGLVGKKLKEKEKISLMKQALNRVNLSYLDLKQPIFELSGGEAQRVALAKIILKDPPLILADEPTASLDPKNSEELLSILESLKNPNRTIIIATHNPLIWEQVDQVIRVTDLSHR

SEQ ID NO: 4216 - protein, 181 aa, Streptococcus pneumoniae
  misc_feature (B) LOCATION 1...181
  hypothetical: YES
IWNSPSSFLILFENLFKPRQRRLAVRMVHTTSDLSTTSKQCFEQPEASFLVCSLVFIEYNTLLEVGLNSLISLFTFTFDILYPIVKVGHTDDYSHGAVKLSVSLVDKDVMKKISVTVIGYFEINIDENITDILYVNGTAILYPYLRSIVSIVSAIDSSEAMLLPTINVLELLDKSQPFEEE

SEQ ID NO: 4217 - protein, 220 aa, Streptococcus pneumoniae
  misc_feature (B) LOCATION 1...220
  hypothetical: YES
VRNRMPITSLEIKDKTFGTRFRGFDPEEVDEFLDIVVRDYEDLVRANHDKNLRIKSLEERLSYFDEIKDSLSQSVLIAQDTAERVKQAAHERSNNIIHQAEQDAQRLLEEAKYKANEILRQATDNAKKVAVETEELKNKSRVFHQRLKSTIESQLAIVESSDWEDILRPTATYLQTSDEAFKEVVSEVLGEPIPAPIEEEPIDMTRQFSQAEMAELQARN

SEQ ID NO: 4218 - protein, 61 aa, Streptococcus pneumoniae
  misc_feature (B) LOCATION 1...61
  hypothetical: YES
KLDSMPFMMEKSSNTLRKSLQATSTSPYRRYMILTLSILSTTSKQCFEVVDSFLVCSLIFI

SEQ ID NO: 4219 - protein, 106 aa, Streptococcus pneumoniae
  misc_feature (B) LOCATION 1...106
  hypothetical: YES
KIDRDKLKIYIETHPDAYLTEIAAEFNCPPTTIHYALKAMGYSLKKSRTYCEQDPEKVNRFLKELNHLSYLTPIYIYETGVETYFYLEYDRALSRQLVSLKEDIII

SEQ ID NO: 4220 - protein, 241 aa, Streptococcus pneumoniae
  misc_feature (B) LOCATION 1...241
  hypothetical: YES
RKDRNEVKNMLPAYMKIHDQIKKDIDEHRWAIGERLPSERDLAEQFAVSRMTLRQAVSLLVEEGVLERRVGSGTFVSSTRVQEKMRGTTSFTEIVKSQGKVPSSQLISYKKTIPNEQEVAKLGIFPTDNIIRMERVRYADQVPLVYEVASIPEKFIKDFKKEEITSHFFQTLQKHGYRIGKSQQTIYARLAKEKIAHYLEVEKGHAILGLTQVSYLEDGTAFEYVKSQYVGERFEFYLENN

SEQ ID NO: 4221 - protein, 336 aa, Streptococcus pneumoniae
  misc_feature (B) LOCATION 1...336
  hypothetical: YES
MKDRYILAFETSCDETSVAVLKNDDELLSNVIASQIESHKRFGGVVPEVASRHHVEVITACIEEALAEAGITEEDVTAVAVTYGPGLVGALLVGLSAAKAFAWAHGLPLIPVNHMAGHLMAAQSVEPLEFPLLALLVSGGHTELVYVSEAGDYKIVGETRDDAVGEAYDKVGRVMGLTYPAGREIDELAHQGQDIYDFPRAMIKEDNLEFSFSGLKSAFINLHHNAEQKGESLSTEDLCASFQAAVMDILMAKTKKALEEYPVKTLFVAGGVAANKGLRERLAAEITDVKVIIPPLRLCGDNAGMIAYASVSEWNKENFAGWDLNAKPSLAFDTME

SEQ ID NO: 4222 - protein, 290 aa, Streptococcus pneumoniae
  misc_feature (B) LOCATION 1...290
  hypothetical: YES
CYRSAMLPDVRDGLTPVHRRILYGMNELGVTQNKPHNTSARITGDVMGKYHPHGDSSIYEAMVRMAQWWSYRYMLVDGHGNFGSMDGDSAAAQRYTEARMSKIALEMLRDINKNTVDFVDNYDANEREPLVLPARFPNLLVNGATGIAVGMATNIPPHNLGETIDAVKLVMDNPEVTTKDLMEVLPGPDFPTGALVMGKSGIHKAYETGKGSIVLRSRTEIETTKTGRERIVVTEFPYMVNKTNVHEHIVRLVQEKRIEGITAVRDESNREGVRFVIEVKRDASANVILI

SEQ ID NO: 4223 - protein, 285 aa, Streptococcus pneumoniae
  misc_feature (B) LOCATION 1...285
  hypothetical: YES
FNSRIDIIVVMEKKKLRINMLSSSEKVAGQGVSGAYRELVRLLHRAAKDQLIVTENLPIEADVTHFHTIDFPYYLSTFQKKRSGRKIGYVHFLPATLEGSLKIPFFLKGIVKRYVFSFYNRMEHLVVVNPMFIEDLVAAGIPREKVTYIPNFVNKEKWHPLPQEEVVRLRTDLGLSDNQFIVVGAGQVQKRKGIDDFIRLAEELPQITFIWAGGFSFGGMTDGYEHYKKIMENPPKNLIFPGIVSPERMRELYALADLFLLPSYNELFPMTILEAASCEARYYVA

SEQ ID NO: 4224 - protein, 262 aa, Streptococcus pneumoniae
  misc_feature (B) LOCATION 1...262
  hypothetical: YES
DSSRKRGDNMLKQEKLTKILEIVNSKGTITVKQIMDEIAVSDMTARRYLQELADKDLLIRVHGGAEKLRTNSLLTNERSNIEKQALQTAEKQEIAHFAGSLVEERETIFIGPGTTLEFFARELPIDNIRVVTNSLPVFLILSERKLTDLILIGGNYRDITGAFVGTLTLQNLSNLQFSKAFVSCNGIQNGALATFSEEEGEAQRIALNNSNKKYLLADHSKFNKFDFYTFYNISNLDTIVSDSKLSDSILFKLSKHIKVIKP

SEQ ID NO: 4225 - protein, 250 aa, Streptococcus pneumoniae
  misc_feature (B) LOCATION 1...250
  hypothetical: YES
TLSRMKFSGACVKIQFFKLVVKTIARKHGLYATFMAKPKFGIAGSGMHCNMSLFDAEGNNAFFDPNDPKGMQLSETAYHFLGGLIKHAYNYTAIMNPTVNSYKRLVPGYEAPVYIAWAGRNRSPLVRVPASRGMGTRLELRSVDPMANPYVAMAVLLEVGLYGIENKIEAPAPIEENIYIMTAEERKEAGITDLPSTLHNALKALTEDEVVKAALGDHIYTSFLEAKRIEWASYATFVSQWEIDNYLDLY

SEQ ID NO: 4226 - protein, 277 aa, Streptococcus pneumoniae
  misc_feature (B) LOCATION 1...277
  hypothetical: YES
YKGRDMNRFKKSKYVIIVFVTVLLVSALLATTYSSTIVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEEKSTIVNLLTNTENADKISVKIQHGSTTIYGIIIGYDKENDVLKISQLNSNSDISAGDKVTTGGLGNFNVADIPVGEVVATTHSTDYLTREVTVKLSADTHNVDVIELVGNS

SEQ ID NO: 4227 - protein, 445 aa, Streptococcus pneumoniae
  misc_feature (B) LOCATION 1...445
  hypothetical: YES
KMFSKLKKTWYADDFSYFIRNFGVFTLIFSTMTLIILQVMHSSLYTSVDDKLHGLSENPQAVIQLAINRATEEIKDLENARADASKVEIKPNVSSNTEVILFDKDFTQLLSGNRFLGLDKIKLEKKELGHIYQIQVFNSYGQEEIYRVILMETNISSVSTNIKYAAVLINTSQLEQASQKHEQLIVVVMASFWILSLLASLYLARVSVRPLLESMQKQQSFVENASHELRTPLAVLQNRLETLFRKPEATIMDVSESIASSLEEVRNMRFLTTSLLNLARRDDGIKPELAEVPTSFFNTTFTNYEMIASENNRVFRFENRIHRTIVTDQLLLKQLMTILFDNAVKYTEEDGEIDFLISATDRNLYLLVSDNGIGISTEDKKKIFDRFYRVDKARTRQKGGFGLGLSLAKQIVDALKGTVTVKDNKPKGTIFEVKIAIQTPSKKKK

SEQ ID NO: 4228 - protein, 113 aa, Streptococcus pneumoniae
  misc_feature (B) LOCATION 1...113
  hypothetical: YES
SGLSWHVGHRDKRLGSLSGGQKQRAVIARMFASDPDVFILDEPTTGMDAGSKNEFYELMHHSAHHHGKAVLMITHDPEEVKDYADRNIHLVRNQDSPWRCFNVHENGQEVGHA

SEQ ID NO: 4229 - protein, 77 aa, Streptococcus pneumoniae
  misc_feature (B) LOCATION 1...77
  hypothetical: YES
PKLSLKKRGWLFSQSFEGAKARAIIMSLLETAKRHQLNSEKYLSYLLECLPNEETLVNKEVLEAYLPWTKVVQEKCK

SEQ ID NO: 4230 - protein, 229 aa, Streptococcus pneumoniae
  misc_feature (B) LOCATION 1...229
  hypothetical: YES
KWLRNPSCRRYHDSNRDSQGIVDCNVLAMPAAIFFSIENTNISRMKRVTSSSYNIEKVCDVNQISRQLVGGQIDLETAFKQLTALQAQPLPYTKLQVTLAATFSAPFFSVMFSGNIYDALGAGVATLFGFAFSLYVEKFIRIPFVTAFAGAFVFGIIAQFWARYTGFPSTADLIIAGAVMPFVPGIALTNAVRDIMTNHINSGMSKMFESLLITLALGAGTSVALVLMN

SEQ ID NO: 4231 - protein, 708 aa, Streptococcus pneumoniae
  misc_feature (B) LOCATION 1...708
  hypothetical: YES
VPISGTGSTVSTNAKPNEVVSSLGSLSSNPSSLTTSKELSSASDGYIFNPKDIVEETATAYIVRHGDHFHYIPKSNQIGQPTLPYNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 4232 - protein, 159 aa, Streptococcus pneumoniae
  misc_feature (B) LOCATION 1...159
  hypothetical: YES
LTIRNEGKSMIFDDLKNITFYKGIHPNLDKAIDYLYQHRKDSFELGKYDIDGDKVFLVVQENVLNQAENDQFEYHKNYADLHLLVEGHEYSSYGSRIKDEAVAFDEASDIGFVHCHEHYPLLLGYHNFAIFFPGEPHQPNGYAGMEEKVRKYLFKILID

SEQ ID NO: 4233 - protein, 252 aa, Streptococcus pneumoniae
  misc_feature (B) LOCATION 1...252
  hypothetical: YES
IEISRSYKVKRKDFNMTSLKLLKEKAPLVICITNDVVKNFTANGLVALGVSPAMSEFPADLEDLLKYAGGLLINIGTLTDENWKLYQAALKIAEKYNVPAVLDPVACGAGEYRKKVADDLINNYKLAAIRGNAGEIASLVGIDVASKGVDSAGVDNIDEIALAANEKFNIPIVVTGEVDAIAVNGEVVTIHNGSAMMPKVIWDRMLIRSCSSKLYRTRKRSRIEIIRNSNVSLQYRWRNGRKTSKWTSSWDI

SEQ ID NO: 4234 - protein, 406 aa, Streptococcus pneumoniae
  misc_feature (B) LOCATION 1...406
  hypothetical: YES
TRIRSGSMRNMWVVIKETYLRHVKSWSFFFMVISPFLFLGISVGIGHIQGSSMAKNNKVAVVTTVPSVAEGLKNVNGVNFDYKDEASAKEAIKEEKLKGYLTIDQEDSVLKAVYHGETSLENGIKFEVTGTLNELQNQLNRSTASLSQEQEKRLAQTIQFTEKIDEAKENKKFIQTIAAGALGFFLYMILITYAGVTAQEVASEKGTKIMEVVFSSIRASHYFYARMMALFLVILTHIGIYVVGGLAAVLLFKDLPFLAQSGILVHLGDAISLNTLLFILISLFMYVVLAAFLGSMASRPEDSGKALSPLMILIMGGFFGVTALGAAGDNLLLKIGSYIPFISTFFMPFRTINDYAGGAEAWISLAITVIFAVVATGFIGRMYASLVLQTDDLGIWKTFKRALSYK

SEQ ID NO: 4235 - protein, 85 aa, Streptococcus pneumoniae
  misc_feature (B) LOCATION 1...85
  hypothetical: YES
LDSSSVLAVFKKQSISPHKHNILLLFEEVNSLCLFLLFIFYFFIKLLSQTLILQPDWLLRDKHSSYLLNDLLLQGMLTSQTMVQR

SEQ ID NO: 4236 - protein, 62 aa, Streptococcus pneumoniae
  misc_feature (B) LOCATION 1...62
  hypothetical: YES
VIPRARASSRNFSTSLTVGRHPSIIFVLKAYQTLLKTDRFSKAIPMIVIFSLSISKDICYLL

SEQ ID NO: 4237 - protein, 383 aa, Streptococcus pneumoniae
  misc_feature (B) LOCATION 1...383
  hypothetical: YES
ESWLVVYWKNWGQTVIVLNIDDGRAKGSARIVEPVDIFEALDPHRDLFIAFGGHAGAAGMTLEVEQLSDLSQVLEDYVREKGADAGGKNKLNLDEELDLEALSLETVKSFERLAPFGMDNQKPIFYIKNFQVESARTMGAGNAHLKLKISKGEASFEVVAFGQGRWATEFSQTKNLELAVKLSVNQWNGQTALQLMMVDARVEGVQLFNIRGKNAVLPEGVPVLDFPGELPNLAASEAIVVKNIPEDITQLKTIFQEQHFSAVYFKNDIDKAYYLTGYGTRDQFAKLYKTIYQFPEFDIRYKLKDLAAYLNIQQILLVKMIQVFEELGFVTIKDGVMTVNKEAPKREIGESQIYQNLKQTVKDQEMMALGTVQEIYDFLMEKE

SEQ ID NO: 4238 - protein, 242 aa, Streptococcus pneumoniae
  misc_feature (B) LOCATION 1...242
  hypothetical: YES
KKWLLTAGVVLSTSAILVACGKTDKEADAPTTFSYVYAVDPASLGYSIATRTSRTDVIGNVIDGLMENDKYGNVAPSQKDYDLNSTGWAPSYQDPASYLNIMDPKSGSAMKHLGITKGKDKDVVAKPGLDKYKKLLEDAVSEITDLEKRYEKYAKAQAWSTDSSLLMPTASSGGFPVVSNVVPFSKPYSQVGIKGEPYIFKGMKLQKDIVTTKEYNEVFKKWQKEKLESNSKYQKELEKYIK

SEQ ID NO: 4239 - protein, 259 aa, Streptococcus pneumoniae
  misc_feature (B) LOCATION 1...259
  hypothetical: YES
RSTSSIDGYERSEWRYKGSSRCCSSNDCYSHILNVLSRILVKENKMKILVTGFNPFGGEKINPALEAVKLLPSEINGAEVRWVEIPTVFYKSSEVLEAEILRYQPDAVLCIGQAGGRTGLTPERVAINQDDARIPDNEGNQPIDTPIRIDGASAYFSSLPIKAMVQAIKKQGLPAVVSNSAGTFVCNHLMYQALYLVDKKFPNMRAGFMHIPYMMEQVVNKPNTAGMSLCDIVRGIEVAIEAIVDYKDKDLQLVGGETH

SEQ ID NO: 4240 - protein, 80 aa, Streptococcus pneumoniae
  misc_feature (B) LOCATION 1...80
  hypothetical: YES
LGTSCLGRRRSPSTSLDFHPCTNRWWSSCSPCCKKFPWNRRIIETQKALLLILRNRAFSYDTLRKSLQTTSASPCRRYGY

SEQ ID NO: 4241 - protein, 90 aa, Streptococcus pneumoniae
  misc_feature (B) LOCATION 1...90
  hypothetical: YES
KTTSPTSLNKREGRKNKYKGGEEMRPRRYPYSGKKESTFVKADPELVEKLLRNTSFLERLQKKPINFQIDSEEFKRLSYEAIHDTSQVTQ

SEQ ID NO: 4242 - protein, 171 aa, Streptococcus pneumoniae
  misc_feature (B) LOCATION 1...171
  hypothetical: YES
ECARSLLCQTDQRLVVLALTRKAIMKIIIQRVKKAQVSIEGQIQGKINQGLLLLVGVGPEDQEEDLDYAVRKLVNMRIFSDAEGKMNLSVKDIEGEILSISQFTLFADTKKGNRPAFTGAAKPDMASDFYDAFNQKLAQEVPVQTGIFGADMQVELVNNGPVTIILDTKKR

SEQ ID NO: 4243 - protein, 181 aa, Streptococcus pneumoniae
  misc_feature (B) LOCATION 1...181
  hypothetical: YES
LDYSKKGKLKMRIAIGCDHIVTDEKMAVSEFLKSKGYEVIDFGTYDHTRTHYPIFGKKVGEAVTSGQADLGVCICGTGVGINNAVNKVPGVRSALVRDMTTALYAKEQLNANVIGFGGKITGELLMCDIIEAFIHAEYKPSEENKKLIAKIEHLESHNAQQTDANFFTEFLEKWDRGEYHD

SEQ ID NO: 4244 - protein, 91 aa, Streptococcus pneumoniae
  misc_feature (B) LOCATION 1...91
  hypothetical: YES
PIRLISIKEILMKLFKPLLTVLALAFALIFITACSSGGNAGSSSGKTTAKARTIDEIKKSGELRIAVFGDKKPFGYVDNDGSYQGYATILN

SEQ ID NO: 4245 - protein, 102 aa, Streptococcus pneumoniae
  misc_feature (B) LOCATION 1...102
  hypothetical: YES
VLYRIQGRIWWLKKKSYFLCGLFLLEVVQRRFYQPLFQIWIQKSMILIFLKWSTLTRDMNLFQSMYAFYDPYQDYRQTRWLRAFLWRMRILFSKTGSSFACK

SEQ ID NO: 4246 - protein, 245 aa, Streptococcus pneumoniae
  misc_feature (B) LOCATION 1...245
  hypothetical: YES
DRHSMRLDNLLAQEKISRKAMKQALLRGEILVDGCPARSLAQNIDTGLQELLFQDRIIQGYEHTYLMLHKPAGVVTANKDKELPTVMDLLPSDIQSDKLYAVGRLDRDTTGLLLLTDNGPLGFQLLHPQYHVDKTYQVQVNGLLTPDHIQTFQKGIVFLDGTICKPARLEILSASPSFSQASITISEGKFHQIKKMFLSVGVKVTSLKRIQFGDFTLNPDLAESNYRPLNQKELQIIKNYLEMSR

SEQ ID NO: 4247 - protein, 76 aa, Streptococcus pneumoniae
  misc_feature (B) LOCATION 1...76
  hypothetical: YES
LHNSFISIQLNQTGLTATALFFQQVMVQCSFMLFFTFLVLKMSAWMRLRASVNGVQKHQVTQNLVIRQGLMLRQVL

SEQ ID NO: 4248 - protein, 103 aa, Streptococcus pneumoniae
  misc_feature (B) LOCATION 1...103
  hypothetical: YES
KANSLEINVDCDYEPESAPQKGLYMNERYQCLKTKEYQALLSSKGRQIFAKRKIDMKSVFGQIKVCLGYKRCHLRGKRQVRIDMGFVLMANNLLKYNKRKRQN

SEQ ID NO: 4249 - protein, 259 aa, Streptococcus pneumoniae
  misc_feature (B) LOCATION 1...259
  hypothetical: YES
RKNRGVQMSEAGHKFLAKLGKKRLRPGGKRATDWLIAEGGLSKEKRILEVACNRGTTAIELAQRFGCKITAVDMDAQALEVAKKSAGTAGVAHLISFERANAMKLPYQDASFDIVINEAMLTMQADQANKKCVMEYLRVLKPGGLLLTHDVLLKEAKESIRQELSQAIHVNVGPLTQDGWEQVMIESGYCDVKVLTGEMTLMKLSGMIYDEGWLGTLKICVNACKKENRKQFLTMYKMFAKNKQKLGFIAMASYKSSKR

SEQ ID NO: 4250 - protein, 152 aa, Streptococcus pneumoniae
  misc_feature (B) LOCATION 1...152
  hypothetical: YES
RMNRREAVEFVNMCMIKNGDKVLVQDRVSPDWSGITFPGGHVERGESFVDAVIREVKEETGLIISKPQLCGIKNWYDDKDYRYVVLFYKTEHFTGELQSSDEGKVWWEDFENLSHLKLATDDMSDMLRVFLEEDLSEFFYYKNGDDWLYDLK

SEQ ID NO: 4251 - protein, 153 aa, Streptococcus pneumoniae
  misc_feature (B) LOCATION 1...153
  hypothetical: YES
CLDRVRSAYCSRVCEGWAALDSLKDVKANASDSKPAQDKKDAKQGTEDSKDSDKMTETNSVPAGVIVVSLLALLGVIAFWLIRRKKESEIQQLSTELIKVLGQLDAEKADKKVLAKAQNLLQETLDFVKEENGSAETETKLVEELKAILDKLK

SEQ ID NO: 4252 - protein, 366 aa, Streptococcus pneumoniae
  misc_feature (B) LOCATION 1...366
  hypothetical: YES
AKDRASTTNEMTATTSNETKPEAGKAIESIQETALTQATESPEQPPLKAQPTGPLVPPTPGRGFNTPIYQSVHKGELFSTGNTNLKIANENTAAAQTFLNTRGASSGYAINNFPLEFADVDNDPNTYNSSRAYIDLNGAKEIAWAGLFWSASRYKGPAYGTNLSDEEISAPVQFTTPNGTVQRVSPQRYHRIDQDATNPGQRFGYNNTGFSNYADVTSILQGDKSATGSYTLADIPMTSSLNGQYQYYNFSGWSLFVVTKDQASKSRAFSIYYGARGNAAGTNNEFTMSNFLTAKQGNLDPIVTWFTVQGDKYWTGDNAQIKNSAGTWVNISNTLNPVNNAMNATVTDNDEHLVKQYPGIFAPGSS

SEQ ID NO: 4253 - protein, 69 aa, Streptococcus pneumoniae
  misc_feature (B) LOCATION 1...69
  hypothetical: YES
PFCRTKIKSAWTTALRRWAVIMVVLSFRVSLRLSIIAYSVLASTADKESSKIKISGSKIIARLIANRCF

SEQ ID NO: 4254 - protein, 344 aa, Streptococcus pneumoniae
  misc_feature (B) LOCATION 1...344
  hypothetical: YES
FPSRLGTITKRGKEMKKIAVDAMGGDYAPQAIVEGVNQALSDFSDIEVQLYGDEAKIKQYLTATERVSIIHTDEKIDSDDEPTRAIRNKKNASMVLAAKAVKDGEADAVLSAGNTGALLAAGFFIVGRIKNIDRPGLMSTLPTVDGKGFDMLDLGANAENTAQHLHQYAVLGSFYAKNVRGIAQPRVGLLNNGTESSKGDPLRKETYELLVADESLNFIGNVEARDLMNGVADVVVADGFTGNAVLKSIEGTAMGIMGLLKTAITGGGLRAKLGALLLKDSLRGLKKQLNYSDVGGAVLFGVKAPVVKTHGSSDAKAVYSTIRQIRTMLETDVVAQTAREFSGE

SEQ ID NO: 4255 - protein, 1216 aa, Streptococcus pneumoniae
  misc_feature (B) LOCATION 1...1216
  hypothetical: YES
LTRLGTYLQRRIILAGHDVQYGKHRTRRSFSRIKEVLDLPNLIEIQTDSFKAFLDHGLKEVFEDVLPISNFTDTMELEFVGYEIKEPKYTLEEARIHDASYSAPIFVTFRLINKETSEIKTQEVFFGDFPIMTEMGTFIINGGERIIVSQLVRSPGVYFNDKVDKNGKVGYGSTVIPNRGAWLELESDSKDITYTRIDRTRKIPFTTLVRALGFSGDDEIFDIFGDSELVRNTVEKDIHKNPMDSRTDEALKEIYERLRPGEPKTAESSRSLLVARFFDPRRYDLAAVGRYKINKKLNVKTRLLNQTIAEPLVDPETGEILVEAGTIMTRSVIESIESHLDGDLNKIVYIPNDAAVVTEPVVLQKFKVIAPTDPDRVVTIIGNANPDDKVRTVTPADILAEMSYFLNLAEGLGRVDDIDHLGNRRIRAVGELLANQVRLGLSRMERNVRERMSVQDNEVLTPQQIINIRPVTAAVKEFFGSSQLSQFMDQHNPLSELSHKRRLSALGPGGLTRDRAGYEVRDVHYTHYGRMCPIETPEGPNIGLINNLSSYGHLNKYGFVQTPYRKVDRETGVVTNEIVWLTADEEDEYTVAQANSRLNEDGTFAEKIVMGRHQGVNQEYPANIVDYMDVSPKQVVAVATACIPFLENDDSNRALMGANMQRQAVPLINPQAPYVGTGMEYQAAHDSGAAVIAQYDGKVTYADADKVEVRREDGSLDVYHIQKFRRSNSGTAYNQRTLVKVGDVVEKGDFIADGPSMENGEMALGQNPIVAYMTWEGYNFEDAVIMSERLVKDDVYTSVHLEEYESETRDTKLGPEEITREIPNVGEDALKDLDEMGIIRIGAEVKEGDILVGKVTPKGEKDLSAEERLLHAIFGDKSREVRDTSLRVPHGADGVVRDVKIFTRVNGDELQSGVNMLVRVYIAQKRKIKVGDKMAGRHGNKGVVSRIVPVEDMPYLPDGTPVDIMLNPLGVPSRMNIGQVMELHLGMAARTLGIHIATPVFDGASSEDLWSTVKEAGMDSDAKTILYDGRTGEPFDNRVSVGVMYMIKLHHMVDDKLHARSVGPYSTVTQQPLGGKAQFGGQRFGEMEVWALEAYGASNVLQEILTYKSDDINGRLKAYEAITKGKPIPKPGVPESFRVLVKELQSLGLDMRVLDEDDQEVELRDLDEGMDEDVIHVDDLEKAREKAAQEAKAAFEAEEAEKATKAEATEEAAEQE

SEQ ID NO: 4256 - protein, 435 aa, Streptococcus pneumoniae
  misc_feature (B) LOCATION 1...435
  hypothetical: YES
KILRRNDRMSVSFENKETNRGVLTFTISQDQIKPELDRVFKSVKKSLNVPGFRKGHLPRPIFDKKFGEESLYQDVMNALLPNAYEAAVKEAGLEVVAQPKIDVTSMEKGQDWVIAAEVVTKPEVKLGDYKNLEVSVDVEKEVTDADVEERIERERNNLAELVIKEAAAENGDTVVIDFVGSIDGVEFDGGKGENFSLGLGSGQFIPGFEDQLVGHSAGETVDVIVTFPEDYQAEDLAGKEAKFVTTIHEVKAKEVPALDDELAKDIDEEVETLADLKEKYRKELAAAKEEAYKDAVEGAAIDTAVENAEIVELPEEMIHEEVHRSVNEFLGNLQRQGINPDMYFQITGTTQEDLHNQYQAEAESRTKTNLVIEAVAKAEGFDASEEEIQKEVEQLAADYNMEVAQVQNLLSADMLKHDITIKKAVELITSTATVK

SEQ ID NO: 4257 - protein, 368 aa, Streptococcus pneumoniae
  misc_feature (B) LOCATION 1...368
  hypothetical: YES
KYLRRKYMLKHLNLKGHLLTAISYMIPIVCGAGFLVAIGLAMGGGVPDALVAGKFTIWDALATMGGKALGLLPVVIATGLSYSIAGKPGIAPGFVVGLIANSVGSGFIGGILGGYIAGFLVQAIIKKVKVPNWIKGLMPTLIIPFVASLVSSLIMIYIIGAPIAAFTNWLTSLLQSLGSASNGLMGAVIGVLSAVDFGGPLNKTVYAFVLTLQAEGVKEPLTALQLVNTATPVGFGLAYFIAKLLKKNIYTQEEIETLKSAVPMGIVNIVEGVIPIVMNNLVPGLIATGIGGAVGGAVSLTMGADSAVPFGGVLMLPTMTRPVAGICALLANIVVTGLVYAILRKPIKHTEPVMTVEEEIDLSDIEIL

SEQ ID NO: 4258 - protein, 113 aa, Streptococcus pneumoniae
  misc_feature (B) LOCATION 1...113
  hypothetical: YES
LDLRKGENIMAKALIICAAGMSSSLMAQKTTEFLKGKGKDIVVDAISATEGGKAIAAAAFDLYLVSPQTKMYFKQFEEAGSKAGKPVVQIPPQAYIPIPMGIEKMANLILENI

SEQ ID NO: 4259 - protein, 186 aa, Streptococcus pneumoniae
  misc_feature (B) LOCATION 1...186
  hypothetical: YES
STLRLKSLKEANMAQDIKNEEVEEVQEEEVVETAEETTPEKSELDLANERADEFENKYLRAHAEMQNIQRRANEERQNLQRYRSQDLAKAILPSLDNLERALAVEGLTDDVKKGLGMVQESLIHALKEEGIEEIAADGEFDHNYHMAIQTLPADDEHPVDTIAQVFQKGYKLHDRILRPAMVVVYN

SEQ ID NO: 4260 - protein, 691 aa, Streptococcus pneumoniae
  misc_feature (B) LOCATION 1...691
  hypothetical: YES
KRLRRTCVELLIYLILFLLVLIVSSTTNKLLPFLPLPLVQILLGIVIGLFLPNTDFHLNTELFLALVIGPLLFREAEDTDVTAILKHWRIIVYLIFPVIFISTLSLGGLAHLLWFSLPLAACLAVGAALGPTDLVAFASLSERFSFPKRVSNILKGEGLLNDASGLVAFQVALTAWTTGAFSLGQASSSLIFSILGGFLIGFLTAMTNRFLHTFLLSVRATDIASELLLELSLPLVTFFLAEEVHVSGIIAVVVAGILKASRFKKITLLEAQVDTVTETVWHTVTFMLNGSVFVILGMELEMIAEPILTNPIYNPLLLLLSLIALTFVLFVIRFIMIYGYYAYRTRRLKKKLNKYMKDMFLLTFSGVKGTVSIATILLIPSNLEQEYPLLLFLVAGVTLVSFLTGLLVLPHLSDEEEESKDYLMHIAILNEVTLELEKELEDTRNKLPLYAAIDNYHGRIENLILSQENQDDQEDWAALKLLILSIESDGLEQAYEEGNISNRVYRVYQRYLKNIEQGINRKLASRLTYYFLVSLRILRFLLHEVFTLGKTFRSWKNKEQSRLRALDYDQIAELYLANTEMIIESLENLKGVYSRSLISFMQESRLRETTIISSGAFVERVINRVKPNNINEMLRGYYLERKLIFEYEEKRLITTKYAKKLRQNVNNLENYSLKEAANTLPYDMVELVRRN

SEQ ID NO: 4261 - protein, 206 aa, Streptococcus pneumoniae
  misc_feature (B) LOCATION 1...206
  hypothetical: YES
SMLSLSVLPTVDESGKDGVFQXNVSSLLNQVTILELKDMKIHAVESFDRTCLVTLPVNGADETGGELAGLAVTDEEMAQKAVNYIFETPGGTIYHGADSHFSNYFAKHGKDFKIDVALNNYGENPVGIQDKMTSIDLLRMAENLRTKVIIPVHYDIWSNFMASTNEILELWKMRKDRLQYDFHPFIWEVGGKYTYPQDQHLVEYHH

SEQ ID NO: 4262 - protein, 290 aa, Streptococcus pneumoniae
  misc_feature (B) LOCATION 1...290
  hypothetical: YES
EYLRNLKFKRRSMMKQDERKALIGKYILLILGSVLLLVPLLATLFSSFKPTKDIVDNFFGFPTNFTWDNFSRLLADGIGGYYWNSVVITVLSLLAVMIFIPMAAYSIARNMSKRKAFTIMYTLLILGIFVPFQVIMIPITVMMSKLGLANTFGLILLYLTYAIPQTLFLYVGYIKISIPESLDEAAEIDGANQFTTYFRIIFPMMKPMHATTMIINALWFWNDFMLPLLVLNRDSKMWTLPLFQYNYAGQYFNDYGPSFASYVVGIISITIVYLFFQRHIISGMSNGAVK

SEQ ID NO: 4263 - protein, 127 aa, Streptococcus pneumoniae
  misc_feature (B) LOCATION 1...127
  hypothetical: YES
GRLSMAQSLNKTVLLSTTGTSYLSIAGKVGKFLVGDQALEFYPDVNVEQFIQIPWSHINQIGANVTGCKISRHFEVFTDKGKFLFASKDSGAILKIARDKLGNDKVVKLPTLIQTISQKFKNLFAKK

SEQ ID NO: 4264 - protein, 121 aa, Streptococcus pneumoniae
  misc_feature (B) LOCATION 1...121
  hypothetical: YES
KRRLVMEHLFKMIILLPCFYFFSWIDKDNRESKFFPIFYYFYWIYITLYALFSLAWTVFSVLFFNIVLRNLTDIKLWGIWLLLLLIAFASDWLDYICFKKMLDLRRELGKSKGVHKGRCRN

SEQ ID NO: 4265 - protein, 254 aa, Streptococcus pneumoniae
  misc_feature (B) LOCATION 1...254
  hypothetical: YES
TKISRSFERKKMKLEHKNIFITGSSRGIGLAIAHKFAQAGANIVLNSRGAISEELLAEFSNYGIKVVPISGDVSDFADAKRMIDQAIAELGSVDVLVNNAGITQDTLMLKMTEADFEKVLKVNLTGAFNMTQSVLKPMMKAREGAIINMSSVVGLMGNIGQANYAASKAGLIGFTKSVAREVASRNIRVNVIAPGMIESDMTAILSDKIKEATLAQIPMKEFGQAEQVADLTVFLAGQDYLTGQVVAIDGGLSM

SEQ ID NO: 4266 - protein, 236 aa, Streptococcus pneumoniae
  misc_feature (B) LOCATION 1...236
  hypothetical: YES
RKISRSAMGKRILLLEKERNLAHFLSLELQKEQYRVDLVEEGQKALSMALQTDYDLILLNVNLGDMMAQDFAEKLSRTKPASVIMILDHWEDLQEELEVVQRFAVSYIYKPVFIENLVARISAIFRGRDFIDQHCSLMKVPRTYRNLRIDVEHHTVYRGEEMIALTRREYDLLATLMGSKKVLTREQLLESVWKYESATETNIVDVYIRYLRSKLDVKGQKSYIKTVRGVGYTMQE

SEQ ID NO: 4267 - protein, 1239 aa, Streptococcus pneumoniae
  misc_feature (B) LOCATION 1...1239
  hypothetical: YES
TRISSSLRIEREEIVVDVNRFKSMQITLASPSKVRSWSYGEVKKPETINYRTLKPEREGLFDEVIFGPTKDWECACGKYKRIRYRGIVCDRCGVEVTRTKVRRERMGHIELKAPVSHIWYFKGIPSRMGLTLDMSPRALEEVIYFAAYVVIDPKDTPLEHKSIMTEREYRERLREYGYGSFVAKMGAEAIQDLLKQVDLEKEIAELKEELKTATGQKRVKAIRRLDVLDAFYKSGNKPEWMILNILPVIPPDLRPMLQLDGGRFASSDLNDLYRRVINRNNRLARLLELNAPGIIVQNEKRMLQEAVDALIDNGRRGRPITGPGSRPLKSLSHMLKGKQGRFRQNLLGKRVDFSGRSVIAVGPTLKMYQCGVPREMAIELFKPFVMREIVARDIVQNVKAAKRLVERGDERIWDILEEVIKEHPVLLNRAPTLHRLGIQAFEPVLIDGKALRLHPLVCEAYNADFDGDQMAIHVPLSEEAQAEARILMLAAEHILNPKDGKPVVTPSQDMVLGNYYLTMEEAGREGEGMVFKDRDEAVMAYRNGYVHLHSRVGIATDSLNKPWTEEQRHKVLLTTVGKILFNDIMPEGLPYLQEPNNANLTEGVPAKYFLPLGGDIKEAISNLELNPPFKKKNLGNIIAEIFKRFRTTETSALLDRMKNLGYHHSTLAGLTVGIADIPVVDDKAEIIEESHKRVEQITKQFRRGMITDDERYNAVTAEWRAAREKLEKRLIANQDPKNPIVMMMDSGARGNISNFSQLAGMRGLMAAPNGRIMELPILSNFREGLSVLEMFFSTHGARKGMTDTALKTADSGYLTRRLVDVAQDVIIREDDCGTDRGLLIRSIAEGKEMIESLEERLNGRYTKKTVKHPETGAVIIGPNELITEDKAREIVNAGVEEVTIRSVFTCNTRHGVCRHCYGINLATGDAVEVGEAVGTIAAQSIGEPGTQLTMRTFHTGGVASNTDITQGLPRVQEIFEARNPKGEAVITEVKGQVTAIEEDASTRTKKVFVKGETGEGEYVVPFTARMRVEVGGQVARGAALTEGSIQPKRLLAVRDVLSVETYLLGEVQKVYRSQGVEIGDKHIEVMVRQMIRKVRVMDPGDTDLLMGTLMDINDFTDANKDVLIAGGVPATGRPVLMGITKASLETNSFLSAASFQETTRVLTDAAIRGKKDHLLGLKENVIIGKIIPAGTGMARYRNLEPHAVNEEEYLNPPVEEEGNEETTEVVVDTAVETVEETVE

SEQ ID NO: 4268 - protein, 86 aa, Streptococcus pneumoniae
  misc_feature (B) LOCATION 1...86
  hypothetical: YES
VIVRAKHIHSNNFDATSDGSIIFKKVISNDSLCSSLKNSDDIEIVKILRNEAHLSLCKSILIPRHNLRKTRKIMFKVKIIELTNNS

SEQ ID NO: 4269 - protein, 83 aa, Streptococcus pneumoniae
  misc_feature (B) LOCATION 1...83
  hypothetical: YES
VIVRTKHIHSNDFDATSDGSIIFKKVISDDSLCSTFKNSDDIELFKILRNKAHLHLPIETVTPRTVSTSQDIISGRREKSCSK

SEQ ID NO: 4270 - protein, 304 aa, Streptococcus pneumoniae
  misc_feature (B) LOCATION 1...304
  hypothetical: YES
RRVRRDMSNSLKGTLLTVVAGIAWGVSGTSGQYLMAHGISALVLTNLRLLIAGGILMILAYATAKDKILVFLKDRKSLLSLLIFALIGLFLNQFAYLSAIQETNAGTATVLQYVCPVGILIYSCIKDRVAPTLGEIVSIIFAIGGTFLIATHGQLDQLSMTPAGLFWGLFSALTYALYIILPIALIKKWGSSLVIGVGMVIAGLVALPFTGVLQANIPTSLDFLLAFAGIILIGTVFAYTAFLKGASLIGPVKSSLLASIEPISAVFFAFLIMNEQFYPIDFLGMAMILFAVTLISLKDLFLEK

SEQ ID NO: 4271 - protein, 172 aa, Streptococcus pneumoniae
  misc_feature (B) LOCATION 1...172
  hypothetical: YES
WEVRMELRRPRLADKKAVLDMMTEFEKSQSAHDGGFWDVEDFSYEEWLEGNRNKEMGIWLPENRVPSIQFVLFGESGCALGFLNLRLRLNEGLLNYAGHIGYSIRPSERGKGYAKETLRQGLQVAKEKNIKKALVTCSVNNLASRAVILANGGIFEDARNGVERYWIEVANE

SEQ ID NO: 4272 - protein, 154 aa, Streptococcus pneumoniae
  misc_feature (B) LOCATION 1...154
  hypothetical: YES
KNSSLSFLERKTMANILLAVTGSIASYKSADLVSSLKKQGHQVTVLMTQAATEFIQPLTLQVLSQNPVHLDVMKEPYPDQVNHIELGKKADLFIVVPATANTIAKLAHGFADNMVTSTALALPSHIPKLIAPAMNTKMYDHPVTQNNLKTLETY

SEQ ID NO: 4273 - protein, 193 aa, Streptococcus pneumoniae
  misc_feature (B) LOCATION 1...193
  hypothetical: YES
SCSRKNRIDLIITDVMMPRMGWYDLISEVQYLSPEQPFLFITAKTSEQDKIYGLSLGADDFIAKPFSPRELVLRVHNILRRLHRGGETELISLGNLKMNHSSHEVQIGEEMLDLTVKSFELLWILASNPERVFSKTDLYEKIWKEDYVDDTNTLNVHIHALRQELAKYSSDQTPTIKTVWGLGYKIEKPRGQT

SEQ ID NO: 4274 - protein, 183 aa, Streptococcus pneumoniae
  misc_feature (B) LOCATION 1...183
  hypothetical: YES
PVSSTRQLWLMLIILPTWINLLLKAYAFIGIFGQNGSINQFLEFIGIGSQQLLFTDFSFIFVASYIELPFMILPIFNVLDDMDNNLINASYDLGATKWETFRHVIFPLSMNGVRSGVQSVFIPSLSLFMLTRLIGGNRVITLGTAIEQNFLTNDNYGMGSTIGVILILTMFITMWVTKERRER

SEQ ID NO: 4275 - protein, 94 aa, Streptococcus pneumoniae
  misc_feature (B) LOCATION 1...94
  hypothetical: YES
TSSRLRQMQTTMRVLIQVRFLKMKENFRMEMLVVIRFLKKLSLWLSKYRKQLESMIQRRLSVGFNRATRLMEELEMAGVIGPAEGTKPRKVLQQ

SEQ ID NO: 4276 - protein, 169 aa, Streptococcus pneumoniae
  misc_feature (B) LOCATION 1...169
  hypothetical: YES
TKSRIFCLFFEYLWRMRLMKIWYNEIKEFYMQKFIQAYIEKLDVTTIIENILTKVISLLLLLIVFYIAKKMLHTMVQRIVKPSLKMSRHDVGRQKTISRLLENVFNYTLYFFLLYCILSILGLPVSSLLAGAGIAGVXIGMGTKAFCLMSSMAFSSSLNVNWMWEMRSF

SEQ ID NO: 4277 - protein, 108 aa, Streptococcus pneumoniae
  misc_feature (B) LOCATION 1...108
  hypothetical: YES
EKSRRNLMFVKKGDKVRVIAGKDKGTEAVVLTALPKVNKVIVEGVNIVKKHQRPTNELPQGGIIEKEAAIHVSNVQVLDKNGVAGRVGYKFVDGKKVRYNKKSGEVLD

SEQ ID NO: 4278 - protein, 302 aa, Streptococcus pneumoniae
  misc_feature (B) LOCATION 1...302
  hypothetical: YES
RNGLGQMKQDQLKAWQPAQFDRFVRILEQDQLNHAYLFSGFFGSLEMAQFLAKSLFCTDKVGVLPCEKCRSCKLIEQEEFPDVTLIKPVNQVIKTERIRELVGQFSQAGIESQQQVFIIEQADKMHPNAANSLLKVIEEPQSEVYIFFLTSDEEKMLPTIRSRTQIFHFKKQEEKLILLLEQMGLVKKKATLLAKFSQSRAEAEKLANQASFWTLVDESERLLTWLVAKKKESYLQVAKLANLADDKEKQDQVLRILEVLCGQDLLQVRVRVILQDLLEARKMWQANVSFQNAMEYLVLKEI

SEQ ID NO: 4279 - protein, 61 aa, Streptococcus pneumoniae
  misc_feature (B) LOCATION 1...61
  hypothetical: YES
MPPRKRITAIREVQPDVGLPKMRVRTTTKKVISRERKQDRRPATKAIVKGKSEKLTIPSME

SEQ ID NO: 4280 - protein, 158 aa, Streptococcus pneumoniae
  misc_feature (B) LOCATION 1...158
  hypothetical: YES
KKPRHSLPQLIVLAKTIISQRRQRVNKAKELLKELQDLDMDIQSRIDEINELEAGLLSSPKWSEVKVQGGQTRKVDDVYTQLVVMKEAIEQDTKEVINRKLELGRMINRLKNPKYRAVLRMTYINKGTADSVCYDLNMSRTTYYRLKNEAVLALEEVI

SEQ ID NO: 4281 - protein, 392 aa, Streptococcus pneumoniae
  misc_feature (B) LOCATION 1...392
  hypothetical: YES
RSTRSLNFELCHLVLFIMNAEAAQIMHLHYDKQLEFKTDLLHQALKKFAPAGYENYEIRPTIGMQEPKYYRAKLQFQTRKFKNQVKAGLYAQNSHYLVELKDCLVQDKETQVIANRLAELLTYHQIPITDERKVLGVRTIMVRRARKTGQVQIIIVTNRQLNLTQLVKELVKDFPEVVTVAVNTNTAKTSEIYGEKTEIIWGQESIQEGVLNYEFSLSPRAFYQLNPEQTEVLYSEAVKALDVDKEDHLIDAYCGVGTIGFAFAKKVKTLRGMDIIPEAIEDAKRNAKRMGFDNTHYEAGTAEEIIPRWYKEGYRADALIVDPPRTGLDDKLLDTILTYVPEKMVYISCNVSTLARDLVRLVEVYDLHYIQSVDMFPHTARTEAVVKLIKKV

SEQ ID NO: 4282 - protein, 321 aa, Streptococcus pneumoniae
  misc_feature (B) LOCATION 1...321
  hypothetical: YES
LQTRKFPTSKKSCHFWKAFSKSIVPFGIMPDDVDGEALPTLVLNNIRGTFNVVAVKAPGFGDRRKAMLEDIAILTGGTVITEDLGLELKDATIEALGQAARVTVDKDSTVIVEGAGNPEAISHRVAVIKSQIETTTSEFDREKLQERLAKLSGGVAVIKVGAATETELKEMKLRIEDALNATRAAVEEGIVAGGGTALANVIPAVATLELTGDEATGRNIVLRALEEPVRQIAHNAGFEGSIVIDRLKNAELGIGFNAATGEWVNMIDQGIIDPVKVSRSALQNAASVASLILTTEAVVANKPEPVAPAPAMDPSMMGGMM

SEQ ID NO: 4283 - protein, 137 aa, Streptococcus pneumoniae
  misc_feature (B) LOCATION 1...137
  hypothetical: YES
KFARSNITGIFEERAEKIASDIDRAEEARQKAEVLAQKREDELAGSRKEAKTIIENAKETAEQSKANILADAKLEAGHLKEKANQEIAQNKVEALQSVKGEVADLTISLAGKIISQNLDSHAHKALIDQYIDQLGEA

SEQ ID NO: 4284 - protein, 273 aa, Streptococcus pneumoniae
  misc_feature (B) LOCATION 1...273
  hypothetical: YES
LIARNIDSLNAALTSDSARAKLSQEVLQTLVAENADIIAIQETKLSAKGPTKKHVEILEELFPGYENTWRSSQEPARKGYAGTMFLYKKELTPTISFPEIGAPSTMDLEGRIITLEFDAFFVTQVYTPNAGDGLKRLEKRQVWDVKYAEYLAELDKEKPVLATGDYNVAHNEIDLANPASNRRSPGFTDEERAGFTNLLATGFTDTFRHVHGDVPERYTWWAQRSKTSKINNTGWRIDYWLTSNRIADKVTKSDMIDSGARQDHTPIVLEIDL

SEQ ID NO: 4285 - protein, 97 aa, Streptococcus pneumoniae
  misc_feature (B) LOCATION 1...97
  hypothetical: YES
ATASSHRLRRKLMPITAADIRREVKEKNVTFIRLMFSDILGTMKNVEIPATDEQLDKVLSNKVMFDGSSIEGFVRINESDMYLYPDLDTWTVFPWGR

SEQ ID NO: 4286 - protein, 83 aa, Streptococcus pneumoniae
  misc_feature (B) LOCATION 1...83
  hypothetical: YES
NQARPVWDRVDLGRLMRKSFYTWLMTERNPKSNSPKAILADLAFEESAFPKHTDDFDEVSRFLEEHASFSFNLGDFDSSWQES

SEQ ID NO: 4287 - protein, 285 aa, Streptococcus pneumoniae
  misc_feature (B) LOCATION 1...285
  hypothetical: YES
NYQRFTRKEMGVKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 4288 - protein, 85 aa, Streptococcus pneumoniae
  misc_feature (B) LOCATION 1...85
  hypothetical: YES
TCQSCNKTKIKNKKGVFVMNTKMMEQFSVMDNEMLDRIEGGIFGVDDALFWAGLGYVAGSIVDTAIDDFTNQCRKNPHQWFCVRV

SEQ ID NO: 4289 - protein, 68 aa, Streptococcus pneumoniae
  misc_feature (B) LOCATION 1...68
  hypothetical: YES
WGQRFSSSIVGQSAYGISQFLLNYFEINRGRDAGPLHHRFYTTASSQILPQLVKNGWEKEIHVEHVEL

SEQ ID NO: 4290 - protein, 385 aa, Streptococcus pneumoniae
  misc_feature (B) LOCATION 1...385
  hypothetical: YES
GFKSEENMSKEMLEAFRILEEDKGIKKEDIIDAVVESLRSAYRRRYGQSDSVAIDFNEKTGDFTVYTVREVVDEVFDSRLEISLKDALAINSAYELGDKIKFEEAPAEFGRVAAQSAKQTIMEKMRKQTRAITYNTYKEHEQEIMSGTVERFDNRFIYVNLGSIEAQLSKQDQIPGEVFASHDRIEVYVYKVEDNPRGVNVFVSRSHPEMIKRLMEQEIPEVYDGTVEIMSVAREAGDRTKVAVRSHNPNVDAIGTIVGRGGANIKKITSKFHPARYDAKNDRMVPIEENIDVIEWVADPAEFIYNAIAPAEVDQVIFDENDSKRALVVVPDNKLSLAIGRRGQNVRLAAHLTGYRIDIKSASEFEAMEDAASVELEVENDTVEE

SEQ ID NO: 4291 - protein, 71 aa, Streptococcus pneumoniae
  misc_feature (B) LOCATION 1...71
  hypothetical: YES
RTKSDVISEINTGLPLKKWTFSRAFCRALKSSPNHQIEIRNSLDKTIDFSYSLSFFYLPLYHTFSVYGSSL

SEQ ID NO: 4292 - protein, 96 aa, Streptococcus pneumoniae
  misc_feature (B) LOCATION 1...96
  hypothetical: YES
RTKSDVISEINTGLPLKKWTFSRAFCRALKSSPNHQIEIRNNLDKTIDFSYSLSFISVFHRFHGKRHCWQPSLHACLDQSIVLDLEPRSCLHGQPS

SEQ ID NO: 4293 - protein, 192 aa, Streptococcus pneumoniae
  misc_feature (B) LOCATION 1...192
  hypothetical: YES
WQKRKNLLKVQEKLKLLKEFIKICSKNKMKYFASGGSLLEAARYKGFIPWNDDMALGLPRKHFEKFINEIDFEKYNKNYILESSEMNLGIFQYKLKSAILILGKSYDVCLNLFLLDRMSELVIDGESGFKVPLYNLEVAVDRSRSIIENRELANELGSVAFQRVQSIFEIKEKVSELENIFMSLGEDDNVNI

SEQ ID NO: 4294 - protein, 316 aa, Streptococcus pneumoniae
  misc_feature (B) LOCATION 1...316
  hypothetical: YES
LKKRSLFMAQKIMSLQNRKNQKRRFIFLFLLPTLICFFLFYFYSVVTIFLTSFAKWDYTNLNTPEFLGFDKLFENYRYVFKEYPFFTEALINSVRWAVIGVIIQVPLAVSVAITLSKKLKGWKISRNLYIVPSIISSAAMGLIFLQIYNPNYGVVNQIIHLFNPSFKDSVLLTPGLNIVAMTGAYIFFAGASTIMILGQIFAIPEEVQEAAILDNITGWRKEWYITIPMIKGTIKTVSIMAATSGFLLYNEVFFLTNGAAGTKSISFVIRELAVASSRTQYARANTIGVIQILGGMLIIVCINILFRERKRLKGGK

SEQ ID NO: 4295 - protein, 276 aa, Streptococcus pneumoniae
  misc_feature (B) LOCATION 1...276
  hypothetical: YES
EEKRMKVINQTLLEKVIIERSRSSHKGDYGRLLLLGGTYPYGGAIIVAALAAVKSGAGLVTVGTDRENIPALHSHLPEAMAFALQDKQLLKEQLEKAEVVLLGPGLGDDASGEDLVKQVFAGLKQNQILIVDGGALTILARTSLSFPSSQLILTPHQKEWEKLSGITIEKQKEDTTVSALTSFPKGTILVEKGPATRVWQAGQSDYYQLQVGGPYQATGGMGDTLAGMIAGFVGQFRQASLYERVAVATHLHSAIAQELSQENYVVLPTESAVLLT

SEQ ID NO: 4296 - protein, 85 aa, Streptococcus pneumoniae
  misc_feature (B) LOCATION 1...85
  hypothetical: YES
NRKSEERYEMSKKDKKIEIQVADAKVNVGKDSFEGYTLTIGKKVIGEIAELDGQFAIIKNGNVDSFYKKLEKAVEILIENYNLAK

SEQ ID NO: 4297 - protein, 459 aa, Streptococcus pneumoniae
  misc_feature (B) LOCATION 1...459
  hypothetical: YES
NKKRTILKSGIFKEFLAFYDKIGKSIASMRSSMKLKTNIRHLHGSIRVPGDKSISHRSIIFGSLAEGETKVYDILRGEDVLSTMQVFRDLGVEIEDKDGVITIQGVGMAGLKAPQNALNMGNSGTSIRLISGVLAGADFEVEMFGDDSLSKRPMDRVTLPLKKMGVSISGQTERDLPPLRLKGTKNLRPIHYELPIASAQVKSALMFAALQAKGESVIIEKECTRNHTEDMLKQFGGHLSVDGKKIIVQGPQKLTGQKVVVPGDISSAAFWLVAGLIVPNSRLVLQNVGINETRTGIIDVIRAMGGKLEITEIDPVAKSATLIVESSDLKGTEICGALIPRLIDELPIIALLATQAQGVTVIKDAEELKVKETDRIQVVADALNSMGADITPTADGMIIKGKSALHGARVNTFGDHRIGMMTAIAALLVADGEVELDRAEAINTSYPSFFDDLESLIHG

SEQ ID NO: 4298 - protein, 116 aa, Streptococcus pneumoniae
  misc_feature (B) LOCATION 1...116
  hypothetical: YES
GNESVKNYGEAFRYFRKLNGYSLEYAAADFISKSQLSRFERGENEISLSTFFELLSNINVSIENFCNHLEYYKRSERDDFLVNLSPNFYSLNIKGLEVIKNKQQKLFEKSGKKLIK

SEQ ID NO: 4299 - protein, 91 aa, Streptococcus pneumoniae
  misc_feature (B) LOCATION 1...91
  hypothetical: YES
ACESLADSGYQGLMKIYLQAQTPRKSSKLKPLTAEDKAYNHALSKGRSKVENIFAKVKTFKMFSTTYRNHRKRFGLRMNLIADIINHELGF

SEQ ID NO: 4300 - protein, 429 aa, Streptococcus pneumoniae
  misc_feature (B) LOCATION 1...429
  hypothetical: YES
KCERMRAVDLIQKKRDGQELTSSEIEWLVEGYVSGTVPDYQMSAFAMAVYFKGMTTREISDLTMNMVKTGQEFDLSAIDGVKVDKHSTGGVGDKVTLILAPLVASFGVPVAKMSGRGLGHTGGTIDKLESIKGYQVERSQEDFIRQVQDIGVSVIGQSDQLVKADKLLYALRDVTATVDTIPLIASSVMSKKIAAGADAILLDVTVGEGAFMKTVDEARELAQTMVDLGKVVGRKTVAVITDMSQPLGRAIGNRLEILEALEILQGQGRQDITHFICELAQIMLGLANVNKTVEEVHQHLENGQALAKFEEMVQAQGGDLEDLYRPVNVAHVVEIPAQETGVISALPAMDFGLYAMRLGAGRAVKSDVLDYETGIVFEKKIGDSVQKGEIVAKVYTNEKIPPQLVTDFQKCVKISDEVKKIREIVEIIS

SEQ ID NO: 4301 - protein, 418 aa, Streptococcus pneumoniae
  misc_feature (B) LOCATION 1...418
  hypothetical: YES
ETERMKFVGLVGSNYDQSYNRKLLEFIRRNFKFKFELEVLEIDEVPMFNQDEKWDESFQLRFLYNKITRADGVIIATPEHNHTISASLKSVLEWLSYEVHPFENKPVMIVGASYYDQGTSRAQVHLRKILDAPGVNAYTLPGNEFLLGKAKEAFDNNGNITNEGTVKFLETCLDNFVKYVGVVSKLKKPKPIESEDLDCGKPIATTITEVDPDDPEWVEKVAAITGAVSGDTYVKLDHGILTVNQIDMFLKAMPFELTYADDNNQFLYYNNAHQDPDTMFAKRVPPQSGSRMSTVHGSLPPARMKNVEWVIGTLRNGNQEYVRTIVPGSPAGVINTHNYQAMYYPDGSYAGINEIVFNFQPWLDWYLKETGQRLVGGSGPFAPAAGGHGDADATSGASDSGDVGGHGGDADATAGASY

SEQ ID NO: 4302 - protein, 350 aa, Streptococcus pneumoniae
  misc_feature (B) LOCATION 1...350
  hypothetical: YES
NLERMNKYMNTADFDFHLPEELIAQTPLEKRDASKLLIVNRETGEMQDKHFHSIIDMLEPGDALVMNDTRVLPARLYGQKVETGGHVELLLLKNTSGDEWEVLAKPAKRLKVGTRISFGDGRLSAVVTEELTHGGRIVRFEYQGIFLEVLESLGEMPLPPYIHEKLDDRERYQTVYAKESGSAAAPTAGLHFTKELLAEIQAKGVHLVYLTLHVGLGTFRPVSVDNLDEHEMHSEFYQLSEEAAATLRSVKENGGRVIAVGTTSIRTLETIGSKFDGQIQADSGWTNIFIKPGYEWKVVDAFSTNFHLPKSTLVMLVSAFAGRELVLDAYHHAIQEHYRFFSFGDAMFIY

SEQ ID NO: 4303 - protein, 136 aa, Streptococcus pneumoniae
  misc_feature (B) LOCATION 1...136
  hypothetical: YES
SLERGHSMGIEEQLGEIVIAPRVLEKIIAIATAKVEGVHSFSNRSVSDTLSKLSLGRGIYLKNVDEELTADIYLYLEYGVKVPKVAVAIQKAVKDAVRNMADVELAAINIHVAGIVPDKTPKPELKDLFDEDFLND

SEQ ID NO: 4304 - protein, 136 aa, Streptococcus pneumoniae
  misc_feature (B) LOCATION 1...136
  hypothetical: YES
SLERYLLSQYKGIEVQKIHIKDLVKEGKNFYEMDHPYVAFLPTYLEGGNGVDNGDVEILTTPVGDFIAYGNNASKCFGVVGSGNRNFNNQYCLTAKQYSQRFGFPVLADFEMRGMLEDIKHVAAIIADLYELEKEN

SEQ ID NO: 4305 - protein, 346 aa, Streptococcus pneumoniae
  misc_feature (B) LOCATION 1...346
  hypothetical: YES
KIERGNNKMTNSVFQGRSFLAEKDFTRAELEYLIGLSAHLKDLKKRNIQHHYLAGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTVQENFGRLEGLTLVYCGDGRNNVANSLLVTGAILGVNVHIFSPKELFPEKEIVELAEGFAKESGAHVLITEDADEAVKDADVLYTDVWVSMGEEDKFAERVALLKPYQVNMDLVKKAGNENLIFLHCLPAFHDTHTVYGKDVAEKFGVEEMEVTDEVFRSKYARHFDQAENRMHTIKAVMAATLGNLYIPKV

SEQ ID NO: 4306 - protein, 184 aa, Streptococcus pneumoniae
  misc_feature (B) LOCATION 1...184
  hypothetical: YES
IVESWLVMKLPKEGDFITIQSYKHDGSLHRTWRDTMVLKTTENAIIGVNDHTLVTESDGRRWVTREPAIVYFHKKYWFNIIAMIRDNGTSYYCNMASPYYLDEEALKYIDYDLDVKIFTDGEKRLLDVEEYERHKRKMNYSDDLDYILKEHVKILVDWINNGRGPFSEAYVNIWYKRYVELKNR

SEQ ID NO: 4307 - protein, 238 aa, Streptococcus pneumoniae
  misc_feature (B) LOCATION 1...238
  hypothetical: YES
MEESINPIISIGPVIFNLTMLAMTLLIVGVIFVFIYWASRNMTLKPKGKQNVLEYVYDFVIGFTEPNIGSRYMKDYSLFFLCLFLFMVIANNLGLMTKLQTIDGTNWWSSPTANLPYDLTLSFLVILLTHIESVRRRGFKKSIKSFMSPVFVIPMNILEEFTNFLSLALRIFGNIFAGEVMTSLLLLLSHQAIYWYPVAFGANLAWTAFSVFISCIQAYVFTLLTSVYLGNKINIEEE

SEQ ID NO: 4308 - protein, 223 aa, Streptococcus pneumoniae
  misc_feature (B) LOCATION 1...223
  hypothetical: YES
QRERTFGSLKINRKTQLALLAEFYSKEGNMNTNLASFIVGLIIDENDRFYFVQKDGQTYALAKEEGQHTVGDTVKGFAYTDMKQKLRLTTLEVTATQDQFGWGRVTEVRKDLGVFVDTGLPDKEIVVSLDILPELKELCPKKGDQSTSVLKWIRKTVFGASWLIKKTSNVLLVLLTTTCRTKTGQPLFTVSSCQELLFTYQKIICLVLFILASVTQSHVWGKY

SEQ ID NO: 4309 - protein, 830 aa, Streptococcus pneumoniae
  misc_feature (B) LOCATION 1...830
  hypothetical: YES
SEERMKINKKYLAGSVAVLALSVCSYELGRHQAGQVKKESNRVSYIDGDQAGQKAENLTPDEVSKREGINAEQIVIKITDQGYVTSHGDHYHYYNGKVPYDAIISEELLMKDPNYQLKDSDIVNEIKGGYVIKVDGKYYVYLKDAAHADNIRTKEEIKRQKQEHSHNHNSRADNAVAAARAQGRYTTDDGYIFNASDIIEDTGDAYIVPHGDHYHYIPKNELSASELAAAEAYWNGKQGSRPSSSSSYNANPVQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK

SEQ ID NO: 4310 - protein, 247 aa, Streptococcus pneumoniae
  misc_feature (B) LOCATION 1...247
  hypothetical: YES
NLRRWVHTVVLTGDIPAMWLRDSTAQLRPYLHVAKRDALLRQTIAGLVKRQMTLVLKDPYANSFNIEENWKGHHETDHTDLNGWIWERKYEVDSLCYPLQLAYLLWKETGETSQFDEIFVVATKEILHLWTVEQDHKNSPYRFVRDTDRKEDTLVNDGFGPDFAVTGMTWSAFRPSDDCCQYSYLIPSNMFAVVVLGYVQEIFAALNLADSQSVIADAKRLQDEIKKESKTTLTPPTARAKRFTLLK

SEQ ID NO: 4311 - protein, 284 aa, Streptococcus pneumoniae
  misc_feature (B) LOCATION 1...284
  hypothetical: YES
IIRRPSCRNTVRPSETLDCLGTCQHLIEGNKMAKNVVITGATSGIGEAIARAYLEQGEDVVLTGRRIDRLEILKSEFAVSFPNQTVWTFPLDVTDMVMVKTVCSDILETIGRIDILVNNAGLALDLAPYQDYEELDMLTMLDTNVKGLMAVTRCFLPAMIKVNQGHVINMGSTAGIYAYAGAAVYSATKAAVKTFSDGLRIDTIATDIKVTTIQPGIVETDFSTVRFHGDKERAASVYQGIEALQAQDIADTVVYVTSQPRRVQITDMTIMANQQATGFMIHKK

SEQ ID NO: 4312 - protein, 409 aa, Streptococcus pneumoniae
  misc_feature (B) LOCATION 1...409
  hypothetical: YES
YNRRINHHHLRTDYVSGDGDFYLESSLCGIIITMQKKPTSAYVHIPFCTQICYYCDFSKVFIKNQPVDSYLEHLLEEFRSYDIEKLSTLYIRGWNTTALSAPQLDVLLNGLTINLDLSVLEELTIEANPGDLDADKIAVLKNSAVNRVSLGVQTFDDKMLKKIGRSHLEKDIYENIDRLKLAGFDNISIDLIYALPGQTMEQVKENVAKAIGLDIPHMSLYSLILENHTVFMNRMRRGKLPLPKEELEAEMFEYIIAELERAGFEHYEISNFSKPGFESRHNLMYWDNAEYYGIGAGASGYVNGVRYKNHGPIRHYLSAVEEGNACITEDHLSQKEQMEEEMFLGLRKKSGVSMARFEEKFGQSFAGLYGEIVRDLVQQGLMQIEGDHVRMTKRGLFLGDTVAERFILE

SEQ ID NO: 4313 - protein, 168 aa, Streptococcus pneumoniae
  misc_feature (B) LOCATION 1...168
  hypothetical: YES
TGRRLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 4314 - protein, 214 aa, Streptococcus pneumoniae
  misc_feature (B) LOCATION 1...214
  hypothetical: YES
GQRRPSYHKENNIHLGSNSCKCVPEDGATVDYYYRENVEETVVPKTATSTETKTITRIIHYVDKVTNQNVKEDVVQPVTLSRTKTENKVTGVVTYGEWTTGNWDEVVSGKIDKYKDPDIPTVESQEVTSDSSDKEITVRYDRLSTPDKPTPDPGTPKTETPVNPDPEVPTYETGKREELPNTGTEANATLASAGIMTLLASLGLGFFKKKEDEK

SEQ ID NO: 4315 - protein, 67 aa, Streptococcus pneumoniae
  misc_feature (B) LOCATION 1...67
  hypothetical: YES
VKRSCKKSLKLKKRIVSGVECTDPQKLDFFCLTFGVQFIRTLVICVLLCRDLYSSKISSNHVSFTLP

SEQ ID NO: 4316 - protein, 105 aa, Streptococcus pneumoniae
  misc_feature (B) LOCATION 1...105
  hypothetical: YES
NRRSTCIMNVYDVIKKPVITDSSMAQLEAGKYVFEVDTRANKLLIKQAVEAAIEGVKVANVNTINVKPKAKRVGRYTGFTNKTKKAIITLTADSKAIELFAAEAE

SEQ ID NO: 4317 - protein, 278 aa, Streptococcus pneumoniae
  misc_feature (B) LOCATION 1...278
  hypothetical: YES
RRRRMSLQETIIQELGVKPVIDAQEEIRRSIDFLKRYLKKHPFLKTFVLGISGGQDSTLAGRLAQLAMEELRAETGDDSYKFIAVRLPYGVQADEADAQKALAFIQPDVSLVVNIKESADAMTAAVEATGSPVSDFNKGNIKARCRMIAQYALAGSHSGAVIGTDHAAENITGFFTKFGDGGADILPLYRLNKRQGKQLLQKLGAEPALYEKIPTADLEEDKPGLADEVALGVTYAEIDDYLEGKTISPETQATIENWWHKGQHKRHLPITVFDDFWE

SEQ ID NO: 4318 - protein, 223 aa, Streptococcus pneumoniae
  misc_feature (B) LOCATION 1...223
  hypothetical: YES
KRRSLMAVKDFMTRKVVYISPDTTVSHAADLMREQGLHRLPVIENDQLVGLVTEGTIAQASPSKATSLSIYEMNYLLNKTKVKDVMIRDVVTVSGYASLEDATYLMLKNKIGILPVVDNHQVYGVITDRDVFQAFLEIAGYGEEGIRVRFVTEDEVGVLGKIVSLIVEENLNISHTVNIPRKDGKVIIEVQIDESIDLPALKEKFEANGIQVEEIARTSAKVL

SEQ ID NO: 4319 - protein, 190 aa, Streptococcus pneumoniae
  misc_feature (B) LOCATION 1...190
  hypothetical: YES
EGRRPMKRSSLLVRMVISIFLVFLILLALVGTFYYQSSSSAIEATIEGNSQTTISQTSHFIQSYIKKLETTSTGLTQQTDVLAYAENPSQDKVEGIRDLFLTILKSDKDLKTVVLVTKSGQVISTDDSVQMKTSSDMMAEDWYQKAIHQGAMPVLTPARKSDSQWVISVTQELVDAKGANLGVLRLDISS

SEQ ID NO: 4320 - protein, 377 aa, Streptococcus pneumoniae
  misc_feature (B) LOCATION 1...377
  hypothetical: YES
NSGSLSQSTPVGAAGFAFIINENHEFVYHPQHTVYSSSSKMEAMKPYIDTGQGYTPGHKSYVSQEKIAGTDWTVLGVSSLEKLDQVRSQLLWTLLGASVTSLLVCLCLVWFSLKRWIAPLKDLRETMLEIASGAQNLRAKEVGAYELREVTRQFNAMLDQIDQLMVAIRSQEETTRQYQLQALSSQINPHFLYNTLDTIIWMAEFHDSQRVVQVTKSLATYFRLALNQGKDLICLSDEINHVRQYLFIQKQRYGDKLEYEINENVTFDNLVLPKLVLQPLVENALYHGIKEKEGQGHIKLSVQKQDSGLVIRIEDDGVGFQDAGDSSQSQLKRGGVGLQNVDQRLKLHFGANYQMKIDSRPQKGTKVEIYINRIETS

SEQ ID NO: 4321 - protein, 750 aa, Streptococcus pneumoniae
  misc_feature (B) LOCATION 1...750
  hypothetical: YES
QSGRTPSGSKRVSEVNCNQSVLDFLLVCNMNLGEFWYNKINKNRGRRLMKKVRFIFLALLFFLASPEGAMASDGTWQGKQYLKEDGSQAANEWVFDTHYQSWFYIKADANYAENEWLKQGDDYFYLKSGGYMAKSEWVEDKGAFYYLDQDGKMKRNAWVGTSYVGATGAKVIEDWVYDSQYDAWFYIKADGQHAEKEWLQIKGKDYYFKSGGYLLTSQWINQAYVNASGAKVQQGWLFDKQYQSWFYIKENGNYADKEWIFENGHYYYLKSGGYMAANEWIWDKESWFYLKFDGKIAEKEWVYDSHSQAWYYFKSGGYMAANEWIWDKESWFYLKFDGKMAEKEWVYDSHSQAWYYFKSGGYMTANEWIWDKESWFYLKSDGKIAEKEWVYDSHSQAWYYFKSGGYMTANEWIWDKESWFYLKSDGKMAEKEWVYDSHSQAWYYFKSGGYMAKNETVDGYQLGSDGKWLGGKATNENAAYYQVVPVTANVYDSDGEKLSYISQGSVVWLDKDRKSDDKRLAITISGLSGYMKTEDLQALDASKDFIPYYESDGHRFYHYVAQNASIPVASHLSDMAVGKKYYSADGLHFDGFKLENPFLFKDLTEATNYSAEELDKVFSLLNINNSLLENKGATFKEAEEHYHINALYLLAHSALESNWGRSKIAKDKNNFFGITAYDTTPYLSAKTFDDVDKGILGATKWIKENYIDRGRTFLGNKASGMNVEYASDPYWGEKIASVMMKINEKLGGKD

SEQ ID NO: 4322 - protein, 215 aa, Streptococcus pneumoniae
  misc_feature (B) LOCATION 1...215
  hypothetical: YES
RVGSLFVEEDNFMEFFDKFHALCFGFLVLIIVITVPYTINHGDFFQNESALIIVSLLVTSLSVAYARKFEMISFGMLSKKQLLLFIAIFLLSVLETLVYIHFFAVSSGSGVQHLAEVSRGISLSLILTTSVFGPIQEELIFRGLLQGAVFDNSWLGLVLTSSLFSFMHGPSNVPSFIFYLLGGLLLGLAYKKSQNLWVSTLVHMFYNSWPLLYYL

SEQ ID NO: 4323 - protein, 190 aa, Streptococcus pneumoniae
  misc_feature (B) LOCATION 1...190
  hypothetical: YES
WRGRTRMDTQKIEAAVKMIIEAVGEDANREGLQETPARVARMYQEIFSGLGQTAEEHLSKSFEIIDDNMVVEKDIFFHTMCEHHFLPFYGRAHIAYIPDGRVAGLSKLARTVEVYSKKPQIQERLNIEVADALMDYLGAKGAFVVIEAEHMCMSMRGVRKPGTATLTTVARGLFETDKDLRDQAYRLMGL

SEQ ID NO: 4324 - protein, 295 aa, Streptococcus pneumoniae
  misc_feature (B) LOCATION 1...295
  hypothetical: YES
DGGRFDACGCQHLPRPYGQEKFGTKTELKNLNSFSNVRKGLEYEVQRQAEILRSGGQIRQETRRYDEANKTTILMRVKEGAADYRYFPEPDLPLFEISDEWIEEMRTELPEFPKERRARYVSDLGLSDYDASQLTANKVTSDFFEKAVALGGDAKQVSNWLQGEVAQFLNAEGKTLEQIELTPENLVEMITIIEDGTISSKIAKKVFVHLAKNGGGAREYVEKAGMVQISDPAILIPIIHQVFADNEAAVADFKSGKRNADKAFTGFLMKATKGQANPQVALKLLAQELAKLKEN

SEQ ID NO: 4325 - protein, 294 aa, Streptococcus pneumoniae
  misc_feature (B) LOCATION 1...294
  hypothetical: YES
IGGSMFYSIKELVEQADLDFQGNVAELMITTEFELTGREREEVFLLMERNLEVMKASVQLGLNENKSRSGLTGGDAAKLDHYIKNEKTLSDYTILSAARNAIAVNEHNAKMGLVCATPTAGSAGCLPSVLTAAIEKLDLSHEQQLDFLFAAGAFGLVIANNASISGAEGGCQAEVGSASAMSAAALTLAAGGTPYQASQAIAFVIKNMLGLICDPVAGLVEVPCVKRNAMGASFAFIAADMALAGIESKIPVDEVIDAMYQVGASMPTAFRETAEGGLATTPTGRRLQKEIFGE

SEQ ID NO: 4326 - protein, 103 aa, Streptococcus pneumoniae
  misc_feature (B) LOCATION 1...103
  hypothetical: YES
PSLRKILRLRLLFSVPWVAVLTICWPMSFCLAILSXXXXXXXXXXXXQKXXXXXXXXXXGXXGXGXXGGGGGGGGGGGGGGGGXXGGGGGXGGGXGXXGGGGG

SEQ ID NO: 4327 - protein, 594 aa, Streptococcus pneumoniae
  misc_feature (B) LOCATION 1...594
  hypothetical: YES
HDLRYEMISISNGKSFKILSGAIHYFRVPPEDWYHSLYNLKALGFNTVETYVAWNLHEPREGEFHFEGDLDLEKFLQIAQDLGLYAIVRPSPFICAEWEFGGLPAWLLTKNMRIRSSDPTYIEAVGRYYDQLLPRLVPRLLDNGGNILMMQVENEYGSYGEDKAYLRAIRQLMEECGVTCPLFTSDGPWRATLKAGTLIEEDLFVTGNFGSKAPYNFSQRQEFFDEHGKKWPLMCMEFWDGWFNRWKEPIITRDPKELADAVREVLEQGSINLYMFHGGTNFGFMNGCSARGTLDLPQVTSYDYDALLDEKRNPTAKYLAVKKMMATHFSEYPQLEPLYKESMELDAIPLVEKVSLFETLDSLSSPVESLYPQKMEELGQSYGYLLYRTETNWDAEEERLRIIDGRDRAQLYVDGQWVKTQYQTEIGEDIFYQGKKKGLSRLDILIENMGRVNYGHKFLADTQRKGIRTGVCKDLHFLLNWKHYPLPLDNPEKIDFSKGWTQGQPAFYAYDFTVEEPKDTYLDLSEFGKGVAFVNGQNLGRFWNVGPTLSLYIPHSYLKEGANRIIIFETEGQYKEEIHLTRKPTLKHIKGENL

SEQ ID NO: 4328 - protein, 127 aa, Streptococcus pneumoniae
  misc_feature (B) LOCATION 1...127
  hypothetical: YES
RLLRCVLSSMMVNHLSYTFITHTKHLVINLLQNQPKLKVLVMSNFDQYHAKFVAETLSYYCSNNFELEVWTELELSKESLEDSPYDIIISNFIIPPIENKRLIYSNNINTVSLIYLLNAMMFIRLDE

SEQ ID NO: 4329 - protein, 92 aa, Streptococcus pneumoniae
  misc_feature (B) LOCATION 1...92
  hypothetical: YES
FSLSIKWSLLDNIWLRRVAIDHQLLRKEKTNTQLMEKILLHNLNQTEFFINKAIGWTLRAYSKTNPTWVACFIDENKERMAELSIKEASKYL

SEQ ID NO: 4330 - protein, 728 aa, Streptococcus pneumoniae
  misc_feature (B) LOCATION 1...728
  hypothetical: YES
FSLSIREKEMNMKFGKRHYRPQVDQMDCGVASLAMVFGYYGSYYFLAHLRELAKTTMDGTTALGLVKVAEEIGFETRAIKADMTLFDLPDLTFPFVAHVLKEGKLLHYYVVTGQDKDSIHIADPDPGVKLTKLPRERFEEEWTGVTLFMAPSPDYKPYKEQKNGLLSFIPILVKQRGLIANIVLATLLVTVINIVGSYYLQSIIDTYVPDQMRSTLGIISIGLVIVYILQQILSYAQEYLLLVLGQRLSIDVILSYIKHVFHLPMSFFATRRTGEIVSRFTDANSIIDALASTILSIFLDVSTVVIISLVLFSQNTNLFFMTLLALPIYTVIIFAFMKPFEKMNRDTMEANAVLSSSIIEDINGIETIKSLTSESQRYQKIDKEFVDYLKKSFTYSRAESQQKALKKVAHLLLNVGILWMGAVLVMDGKMSLGQLITYNTLLVYFTNPLENIINLQTKLQTAQVANNRLNEVYLVASEFEEKKTVEDLSLMKGDMTFKQVHYKYGYGRDVLSDINLIVPQGSKVAFVGISGSGKTTLAKMMVNFYDPSQGEISLGGVNLNQIDKKALRQYINYLPQQPYVFNGTILENLLLGAKEGTTQEDILRAVELAEIREDIERMPLNYQTELTSDGAGISGGQRQRIALARALLTDAPVLILDEATSSLDILTEKRIVDNLMALDKTLIFIAHRLTIAERTEKVVVLDQGKIVEEGKHADLLAQGGFYAHLVNS

SEQ ID NO: 4331 - protein, 291 aa, Streptococcus pneumoniae
  misc_feature (B) LOCATION 1...291
  hypothetical: YES
MAMRNQLALSGEKILEKIYPQLFHHVGMIRGEYLLRELNQNIILASCQQFVKDYLETICSLYSDEEVWYRFSELTNTEANCLVGTREFFDEGHPLFGYRGTRRLLACLDEFQAEAHVVTEVYQTNPNLSVIFPFVNDDDQLKQAITVLRQQGFTGKVGTMIELPSAYFDLSSILETGISKIVVGMNDLTSFVFATMRNSQWHDMESPIMLDMLRDMQDKARKNKIDFAVAGYLNTSFIQKMNQLGIKCIIHYSSIPEIFDLEIDHPDHLKHIKEESKKLQRSTHDTARNVE

SEQ ID NO: 4332 - protein, 117 aa, Streptococcus pneumoniae
  misc_feature (B) LOCATION 1...117
  hypothetical: YES
YTMRYNLLMAYSIDFRKKVLSYCERIGSITEASHVFQISRNTIYGWLKLKEKTGELNHQVKGTKPRKVDRDRLKNYLTDNPDAYLTEIASEFGCHPTTIHYALKAMGYTRKKEPHLL

SEQ ID NO: 4333 - protein, 254 aa, Streptococcus pneumoniae
  misc_feature (B) LOCATION 1...254
  hypothetical: YES
VLMRNLKSILRRHISLLGFLGVLSIWQLAGFLKLLPKFILPTPLEILQPFVRDREFLWHHSWATLRVALLGLILGVLIACLMAVLMDSLTWLNDLIYPMMVVIQTIPTIAIAPILVLWLGYGILPKIVLIILTTTFPIIVSILDGFRHCDKDMLTLFSLMRANPWQILWHFKIPVSLPYFYAGLRVSVSYAFITTVVSEWLGGFEGLGVYMIQSKKLFQYDTMFAIIILVSIISLLGMKLVDISEKYVIKWKRT

SEQ ID NO: 4334 - protein, 959 aa, Streptococcus pneumoniae
  misc_feature (B) LOCATION 1...959
  hypothetical: YES
KMMSVVRKSCGVWKKVMKKKRLLKPRCTLGGKFLDRILSPKSECAYELSAVGQVEAGTNHILWTLRIGQINSQKYYVIRDIPLFLRIVEQRKSYMIGKIYEESLSWEAFDDASQELLTFLHGLTEEGLVSDLFCQNQGRHLFFPLTFFEQGVNLLMALPHFQFDHQVDSYQTLLFQDMHADANLFAFTVTEYSDYFEMEISESPRVNVFYQGAVLFHKGQVYFLTDQQMRLLKEIKALPVGQQGKKYLQFDSSDRDKLASCLTLFIQMGTVSAPERLQIKTFAPSFYFDREEDNRIRLEIQFDYGNRQVSSRQELEELPFSSDADLEERIFQVCLAAGFEADFQSWRQALKAESVYHFFHDIIPVFEKLGHVDLSDKLEELYSLASPQVQIASKGGLLEIQFDFQDIAQEEIDQAMQALVANQDFYIDSSNQVYFFDEETKKIRQNLQELGQFELKDGTLQARKSLAYSLAHLFEGRDRVSFSQEFQNLAQDLTHPEDFPRQATQVQADLRDYQEKGIGWLQMLHHYGFGGILADDMGLGKTLQTIAFLTSQVTKESRVLILAPSGLIYNWADEFQKFAPQLDVAVVHGLKASREEILAESHQIYVTSYATFRQDSEFYQGMAFYFLFLDEAQVMKNAQTKIAQTLRQFVVPSVFALSGTPIENHLGELWSIFQIVMPGLLPSKKEFMKLPAERVAQFIKPFVMRRKKEEVLTELPDLIEVVYKNELEDQQKAIYLAQLQQMRDHLAQVSEQEFQRSRVEILSGLMRLRQICDTPALFMEDYQGASGKLDSLRDLLVQVADGRHRVLIFSQFKGMLEKIEQELPDLGLTSFKITGSTPAKERQDMTKAFNQGERDAFLISLKAGGVGLNLTGADTVILVDLWWNPAVEAQAIGRAHRMGQEETVEVYRLVTKGTIEEKIQELQEQKKHLVSQVLDGTESRGSLTLAEIREILGISEANT

SEQ ID NO: 4335 - protein, 257 aa, Streptococcus pneumoniae
  misc_feature (B) LOCATION 1...257
  hypothetical: YES
FTMRRKCHSERFYFIISELSILSSINQQGNDRGRQYRTGIYYQDEADLPAIYTVVQEQERMLGRKIAVEVEQLRHYILAEDYHQDYLRKNPSGYCHIDVTDADKPLIDAANYEKPSQEVLKASLSEESYRVTQEAATEAPFTNAYDQTFEEGIYVDITTGEPLFFAKDKFASGCGWPSFSRPISKELIHYYKDLSHGMERIEVRSRSGSAHLGHVFTDGPRELGGLRYCINSASLRFVAKDEMEKAGYGYLLPYLNK

SEQ ID NO: 4336 - protein, 74 aa, Streptococcus pneumoniae
  misc_feature (B) LOCATION 1...74
  hypothetical: YES
KQMSISPRFETLEQAIASKDLEKVREAFKKMISTWTINESVVRDNSTAHYGRVETDISFLPSSMETEPTDEFGT

SEQ ID NO: 4337 - protein, 307 aa, Streptococcus pneumoniae
  misc_feature (B) LOCATION 1...307
  hypothetical: YES
KKMSYLKGFNLIKSADLRQTRAGKNYLAFTFQDDSGEIDGKLWDAQPHNIEAFTAGKVVHMKGRREVYNNTPQVNQITLRLPQAGEPNDPADFKVKSPVDVKEIRDYMSQMIFKIENPVWQRIVRNLYTKYDKEFYSYPAAKTNHHAFETGLAYHTATMVRLADAISEVYPQLNKSLLYAGIMLHDLAKVIELTGPDQTEYTVRGNLLGHIALIDSEITKTVMELGIDDTKEEVVLLRHVILSHHGLLEYGSPVRPRIMEAEIIHMIDNLDASMMMMSTALALVDKGEMSNKIFAMDNRSFYKPDLD

SEQ ID NO: 4338 - protein, 242 aa, Streptococcus pneumoniae
  misc_feature (B) LOCATION 1...242
  hypothetical: YES
KKMRINKYIAHAGVASRRKAEELIKQGLVTVNGQVVRELATTIKSGDKVEVEGQPIYNEEKVYYLLNKPRGVISSVTDDKGRKTVVDLLPNVKERIYPVGRLDWDTSGVLILTNDGDFTDEMIHPRNEIDKVYVARVKGVANKDNLRPLTRGLEIDGKKTKPAVYEILKVDPVKNRSVVQLTIHEGRNHQVKKMFEAVGLQVDKLSRTRFGHLDLTGLRPGESRRLNKKEISQLHTMAVTKK

SEQ ID NO: 4339 - protein, 421 aa, Streptococcus pneumoniae
  misc_feature (B) LOCATION 1...421
  hypothetical: YES
TMVSRQEQFEQVQAVKKSINTASEEVKNQALLAMADHLVAATEEILAANALDMAAAKGKISDVMLDRLYLDADRIEAMARGIREVVAFPDPIGEVLETSQLENGLVITKKRVAMGVIGIIYESRPNVTSDAAALTLKSGNAVVLRSGKDAYQTTHAIVTALKKGLETTTIHPNVIQLVEDTSHESSYAMMKAKGYLDLLIPRGGAGLINAVVENAIVPVIETGTGIVHVYVDKDADEDKALSIINNAKTSRPSVCNAMEVLLVHEDKAASILPRLDQMLVAERKEAGLEPIQFRLDSKASQFVSGQAAETQDFDTEFLDYVLAVKVVSSLEEAVAHIESHSTHHSDAIVTENAEAAAYFTDQVDSAAVYVNASTRFTDGGQFGLGCEMGISTQKLHARGPMGLKELTSYKYVVAGDGQIRE

SEQ ID NO: 4340 - protein, 299 aa, Streptococcus pneumoniae
  misc_feature (B) LOCATION 1...299
  hypothetical: YES
LFSRRKTVKKRKKLALSLIAFWLTACLVGCASWIDRGESITAVGSTALQPLVEVAADEFGTIHVGKTVNVQGGGSGTGLSQVQSGAVDIGNSDVFAEEKDGIDASALVDHKVAVRGLALIVNKEVDVDNLTTEQLRQIFIGEVTNWKEVGGKDLPISVINRAAGSGSRATFDTVIMEGQSAMQSQEQDSNGAVKSIVSKSPGAISYLSLTYIDDSVKSMKLNGYDLSPENISSNNWPLWSYEHMYTLGQPNELAAEFLNFVLSDETQEGIVKGLKYIPIKEMKVEKDAAGTVTVLEGRQ

SEQ ID NO: 4341 - protein, 470 aa, Streptococcus pneumoniae
  misc_feature (B) LOCATION 1...470
  hypothetical: YES
VISSFLWYNGNMLFKLSKEKIELGLSRLSPARRIFLSFALVILLGSLLLSLPFVQVESSRATYFDHLFTAVSAVCVTGLSTLPVAHTYNIWGQIICLLLIQIGGLGLMTFIGVFYIQSKQKLSLRSRATIQDSFSYGETRSLRKFVYSIFLTTFLVESLGAILLSFRLIPQLGWGRGLFSSIFLAISAFCNAGFDNLGSTSLFAFQTDLLVNLVIAGLIITGGLGFMVWFDLAGHVGRKKKGRLHFHTKLVLLLTIGLLLFGTATTLFLEWNNAGTIGNLPVADKVLVSFFQTVTMRTAGFSTIDYTQAHPVTLLIYILQMFLGGAPGGTAGGLKITTFFVLLVFARSELLGLPHANVARRTIAPRTVQKSFSVFIIFLMSFLIGLILLGITAKGNPPFIHLIFETISALSTVGVTANLTPDLGKLALSVIMPLMFMGRIGPLTLFVSLADYHPEKKDMIHYMKADISIG

SEQ ID NO: 4342 - protein, 66 aa, Streptococcus pneumoniae
  misc_feature (B) LOCATION 1...66
  hypothetical: YES
GFPSFRRACFFILIPILFNMYSGLILFENQIQTTSISPCRTQVQPAANFLVCTLIFIEYESGIEHC

SEQ ID NO: 4343 - protein, 95 aa, Streptococcus pneumoniae
  misc_feature (B) LOCATION 1...95
  hypothetical: YES
ILPRNKSIFIIFFSQSLHCIFQHHLFKECETITLQLLVLAEELKIYDILGFSQVRLGILQHNSDLIDKGITLLRLTKEEALVKILEKEINDFSNL

SEQ ID NO: 4344 - protein, 222 aa, Streptococcus pneumoniae
  misc_feature (B) LOCATION 1...222
  hypothetical: YES
RLQSKINQRGRRKRGVLREQATRDKKENDAKSSDSSVGEEALPSPSLKPEKKVAEAEKKVAEAEKKAKAQKEEDRRNYPTNTYKTLELEIAESDVKVKEAELELVKEEAKESRNEEKVNQAKAKVESKKAEATRLEKIKTDRKKAEEEAKRKAAEEDKVKEKPAEQPQPAPAPQPEKPTEEPENPAPAPKPDKPAEQPKAEKTDDQQAEEDYARRSEEEYNR

SEQ ID NO: 4345 - protein, 68 aa, Streptococcus pneumoniae
  misc_feature (B) LOCATION 1...68
  hypothetical: YES
RLQRQENLLQYLISGLYRSYTRDAFYQLLKRHGWRNIMPRPEHPKKADAQTIVASKNKISIQEEKKAL

SEQ ID NO: 4346 - protein, 262 aa, Streptococcus pneumoniae
  misc_feature (B) LOCATION 1...262
  hypothetical: YES
LGQRRRTCMFKLSFQSIGHVVVRNYMSFRNLFKISIVPNLIDPLFYLLAMGFGVGAYLTHVNGMLYRDFVITGLIAATAMSAATAETTVNAFIQYKIEKTYDAMLMTPINTSDIVVGQAIWAGIRAVIFGGIFWLISMLITAHFHVLMLLIPLILFIVGYLFGVLGLIFTYLAPSREFLNYYNVLVIRPLYMFSDTFFPITSLPPILGDLTWFSPLYHATRMIRIIWGGEVTGLYLHLIWLIALALLITVLPMYMLHRRYYR

SEQ ID NO: 4347 - protein, 1224 aa, Streptococcus pneumoniae
  misc_feature (B) LOCATION 1...1224
  hypothetical: YES
KNKRGVKSMKLIPFLSEEEIQKLQEAEANSSKEQKKTAEQIEAIYTSGQNILVSASAGSGKTFVMVERILDQLARGVEISQLFISTFTVKAATELKERLEKKISKKIQETDDVDLKQHLGRQLADLPNAAIGTMDSFTQKFLGKHGYLLDIAPNFRILQNQSEQLLLENEVFHEVFEAHYQGKQKETFSHLLKNFAGRGKDERGLRQQVYKIYDFLQSTSNPQKWLSESFLKGFEKADFTSEKEKLTEQIKQALWDLESFFRYHLDNDAKEFAKAAYLENVQLILDEIGSLNQEFDSQAYQAVLARVVAISKEKNGRALTNASRKADLKPLADAYNEERKTQFTKLGQLSDQIAILDYQERYHGDTWKLAKTFQSFMSDFVEAYRQRKRQENAFEFADISHYTIEILENFPQVRESYQERFHEVMVDEYQDTNHIQERMLELLSNGHNRFMVGDIKQSIYRFRQADPQIFNEKFQRYAQNPQEGKLILLKENFRSSSEVLSATNDVFERLMDQEVGEINYDNKHQLVFANTKLTPNPDNKAEFLLYDKDDTGEEEESQTETKLTGEMRLVIKEILKLHQEKGVAFKEIALLTSSRSRNDQILLALSEYGIPVKTDGEQNNYLQSLEVQVMLDTLRVIHNPLQDYALVALMKSPMFGFDEDELARLSLQKAEDKVHENLYEKLVNAQKMASSQKGLIHTALAEKLKQFMDILASWRLYAKTHSLYDLIWKIYNDRFYYDYVGALPNGPARQANLYALALRADQFEKSNFKGLSRFIRMIDQVLEAQHDLASVAVAPPKDAVELMTIHKSKGLEFPYVFILNMDQDFNKQDSMSEVILSRQNGLGVKYIAKMETGAVEDHYPKTIKLSIPSLTYRQNEEELQLASYSEQMRLLYVAMTRAEKKLYLVGKGSREKLESKEYPAAKNGKLNSNTRLQARNFQDWLWAISKVFTKDKLNFSYRFIGEDQLTREAIGELETKSPLQDSSQADNRQSDTIKEALEMLKEVEVYNTLHRAAIELPSVQTPSQIKKFYEPVMDMEGVEIAGQGQSVGKKISFDLPDFSTKEKVTGAEIGSATHELMQRIDLSQQLTLASLTETLKQVQTSQAVRDKINLDKILAFFDTVLGQEILANTDHLYREQPFSMLKRDQKSQEDFVVRGILDGYLLYENKIVLFDYKTDRYDEPSQLVDRYRGQLALYEEALSRAYSIENIEKYLILLGKDEVQVVKV

SEQ ID NO: 4348 - protein, 604 aa, Streptococcus pneumoniae
  misc_feature (B) LOCATION 1...604
  hypothetical: YES
RNKRKKMEQKHRSEFPEKELWDLTALYQDREDFLRAIEKAREDINQFSRDYKGNLHTFEDFEKAFAELEQIYIQMSHIGNYAFMPQTTDYSNDEFANIAQAGMEFETDASVALTFFDDALVVADEEVLDRLGELPHLTAAIRQAKIKKAHYLGADVEKALTNLGEVFYSPQDIYTKMRAGDFEMADFEAHGKTYKNSFVTYENFYQNHEDAEVREKSFRSFSEGLRKHQNTAAAAYLAQVKSEKLLADMKGYDSVFDYLLAEQEVDRVMFDRQIDLIMKDFAPVAQRYLKHVAKVNGLEKMTFADWKLDLDSALNPEVTIDDAYDLVMKSVEPLGQEYCQEVARYQEERWVDFAANSGKDSGGYAADPYRVHPYVLMSWTGRLSDVYTLIHEIGHSGQFIFSDNHQSYFNAHMSTYYVEAPSTFNELLLSDYLENQSNDPRQKRFALAHRLTDTYFHNFITHLLEAAFQRKVYTLIEEGETFGASKLNSIMKEVLTDFWGDAIEIDDDAALTWMRQAHYYMGLYSYTYSAGLVISTAGYLHLKNSETGAEDWLNLLKSGGSKTPLESAMIIGADISTDKPLRDTIQFLSDTVDQIIAYSAELGE

SEQ ID NO: 4349 - protein, 129 aa, Streptococcus pneumoniae
  misc_feature (B) LOCATION 1...129
  hypothetical: YES
KDKRTNKMINIKPVIYKELQKVADNVTDTYPSDWETFPVVIFLEEQNKPGDWFDDQEQKSSIRYKVDIFDDTSTSELAVKINQIFESLGLRRTDCQDVPDPSHLRHKVMRFEGIVDLHSELVFQFRMEN

SEQ ID NO: 4350 - protein, 230 aa, Streptococcus pneumoniae
  misc_feature (B) LOCATION 1...230
  hypothetical: YES
QVKRGEVNMETQDYAFQPGLTVGELLKSSQKDWQAAINHRFVKELFAGTIENKVLKDYLIQDYHFFDAFLSMLGACVAHADKLESKLRFAKQLGFLEADEDGYFQKAFKELKVAEIIYLEVTLHPVTKAFQDLMYSAVASSDYAHLLVMLVIAEGLYLDWGSKDLALPEVYIHSEWINLHRGPFFAEWVQFLVDELNRVGKNREDLTELQQRWNQAVALELAFFDIGYDV

SEQ ID NO: 4351 - protein, 439 aa, Streptococcus pneumoniae
  misc_feature (B) LOCATION 1...439
  hypothetical: YES
GVKRGDIHMKNSKFIDQFATFAGKLGNQIHLKTLRDAFVTVMPLYILAGLIVLLNNTVFKWIFQGDTLTRFQYWGITIANGTLSISGMIIAVMVGYFLAKNRDFENPLAASMLSLVSLIVMMPNTVSVVPDGAKDAVNISGVLSFNNTGTGAMFAGVIVAIIATELFIELSNVKALQMNLGENIPPAVSRSFSVLLPVMTVISLFGVVSALLFNITGLNLISIITIFIQEPIRHIGTSLIGVIIIYSLGNMLWLFGIHQAVIYSAILEPLLLINITENITAANNGQAIPHIINLSQIQTFALMGGSGSTLCLLIATFLVSRNAVSKNVAKLSFGPGIFNINEPVLFGYPIVYNISLAIPFITVPVLGILISYLATVTGFMSPAFIQVPWTTPVFLNAWLATAGDVRAVLVQFIIFALGVLLYIPFIKVNDKVVEQEMEG

SEQ ID NO: 4352 - protein, 451 aa, Streptococcus pneumoniae
  misc_feature (B) LOCATION 1...451
  hypothetical: YES
CRKRRTMKKMRKFLCLAGIALAAVALVACSGKKEATTSTEPPTELSGEITMWHSFTQGPRLESIQKSADAFMQKHPKTKIKIETFSWNDFYTKWTTGLANGNVPDISTALPNQVMEMVNSDALVPLNDSIKRIGQDKFNETALNEAKIGDDYYSVPLYSHAQVMWVRTDLLKEHNIEVPKTWDQLYEASKKLKEAGVYGLSVPFGTNDLMATRFLNFYVRSGGGSLLTKDLKADLTSQLAQDGIKYWVKLYKEISPQDSLNFNVLQQATLFYQGKTAFDFNSGFHIGGINANSPQLIDSIDAYPIPKIKESDKDQGIETSNIPMVVWKNSKHPEVAKAFLEALYNEEDYVKFLDSTPVGMLPTIKGISDSAAYKENETRKKFKHAEEVITEAVKKGTAIGYENGPSVQAGMLTNQHIIEQMFQDIITNGTDPMKAAKEAEKQLNDLFEAVQ

SEQ ID NO: 4353 - protein, 269 aa, Streptococcus pneumoniae
  misc_feature (B) LOCATION 1...269
  hypothetical: YES
PGKRETGFLADACSNPTGLSLKLSNIRGKTLVFFADETINFVKNVIKXTTDKITEDSMQNKPIIIGVTGGSGGGKTSVSRAILSHFPDEKISMIEHDSYYKDQSHLTFEERVKTNYDHPFAFDTDLMIEQIKELLAGRPVDIPTYDYTEHTRSSKTYRQEPQDVFIVEGILVLEDKRLRDLMDIKIFVDTDDDVRIIRRIKRDMEERGRSLDSVINQYLGVVKPMYHQFIESTKRYADIVIPEGVSNTVAIDLLTTKIAKILEEARNSK

SEQ ID NO: 4354 - protein, 79 aa, Streptococcus pneumoniae
  misc_feature (B) LOCATION 1...79
  hypothetical: YES
ILKRSYTMVTVYSKNNCVQCKMTKRFLDSNNVSYREINLDEQPEYVDQVKELGFSAAPVIQTPTEVFSGFQPGKLKQLA

SEQ ID NO: 4355 - protein, 65 aa, Streptococcus pneumoniae
  misc_feature (B) LOCATION 1...65
  hypothetical: YES
RMKRGIIYFFIGLSLLVWLVEMFTDWFDQALLCQFIRGALEFGFMIFVVFPMGMEWLKGESHDGG

SEQ ID NO: 4356 - protein, 66 aa, Streptococcus pneumoniae
  misc_feature (B) LOCATION 1...66
  hypothetical: YES
TMKSSTSWGMIRINSRYNRVKNRMILEWEVMMIPMTVPNIMDKRTDRMDIPIVTPNPCKILRRLFP

SEQ ID NO: 4357 - protein, 439 aa, Streptococcus pneumoniae
  misc_feature (B) LOCATION 1...439
  hypothetical: YES
ERKRPEGSDKIMTSVVVVGTQWGDEGKGKITDFLSANAEVIARYQGGDNAGHTIVIDGKKFKLHLIPSGIFFPEKISVIGNGMVVNPKSLVKELSYLHEEGVTTDNLRISDRAHVILPYHIELDRLQEEAKGDNKIGTTIKGIGPAYMDKAARVGIRIADLLDKDIFRERLERNLAEKNRLFEKLYDSKAIVFDDIFEEYYEYGQQIKKYVIDTSVILNDALDNGKRVLFEGAQGVMLDIDQGTYPFVTSSNPVAGGVTIGSGVGPSKIDKVVGVCKAYTNRVGNGPFPTELFDEVGERIREVGHEYGTTTGRPRRVGWFDSVVMRHNRRVSGITNLSLNSIDVLSGLDTVKICVAYDLDGQRIDYYPASLEQLKRCKPIYEELPGWSEDITGVRNLEDLPENARNYVRRVSELVGVRISTFSVGPGREQTNILESVWS

SEQ ID NO: 4358 - protein, 310 aa, Streptococcus pneumoniae
  misc_feature (B) LOCATION 1...310
  hypothetical: YES
VPESGEGHPKKVKRTPIEGGKRERRKTEIVQELMTEFSLDLLLKVIKLARSTYYYHLKQLDKTDKDQELKAEIQSIFIEHKGNYTYRRVHLELRNRGYLVNHKRVQGLMKVLNLQAKMRQKRKYSSHKGDVGKKAENLIQSQFEGSKTMEKCYTDVTEFAIPASTQKLYLSPVLDGFNSEIIAYHLSTSPNLEQVQTMLEQAFTEKHYENTILHSDQGWQYQHDSYHRFLESKGTQASMLRKGNSQDNGMMESFFGILKSEMFYGYEKTFKSLNQLEQAIIDYIDYYNNKRIKVKLKGLSPVQYRTKSFG

SEQ ID NO: 4359 - protein, 310 aa, Streptococcus pneumoniae
  misc_feature (B) LOCATION 1...310
  hypothetical: YES
VPESGECHPKKVKRTPIEGGKRERRKTEIVQELMTEFSLDLLLKAIKLARSTYYYHLKQLDKTDKDQELKAEIQSIFIEHKGNYAYHRIYLELRNRGYLVNHKRVQGLIKVLNLQAKMRQKRKYSSHKGDVGKKAENLIQGQFEGSKTMEKCYTDVTEFAIPASTQKLYLLPVLDGFNSEIIAYNLSTSPNLEQVQTMLEQAFTEKHYENTILHSDQGWQYQHDSYHRFLESKGIQASMSRKGNSPDNGMMESFFGILKSEMFYGYEKNFRSLENLEQAIVDYIDYYNNKRIKVKLKGLSLVQYRTKSFG

SEQ ID NO: 4360 - protein, 310 aa, Streptococcus pneumoniae
  misc_feature (B) LOCATION 1...310
  hypothetical: YES
VPESGECHPKKVKRTPIEGGKRERRKTEIVQELMTEFLLVLLLKSIKLARWTYYYHLKQLDKTDKDQELKAEIQSIFIEHKGNYAYRRVHLELRNRAYLVNHKRVQGLIKVLNLQAKMRQKRKYSSHKGDVGKKAENLIQGQFEGSKTMEKCYTDVTEFAIPASTQKLYLSPVLDGFNSEIIAFNLSCSPNLEQVQTMLEQAFKEKHYENTILHSDQGWQYQHDSYHRFLESKGIQASMSRKGNSPDNGMMESFFGILKSEMFYGYEKSFQSFKQLEQAIIDYIDYYNNKRIKVKLKGLIPVQYRTKSFG

SEQ ID NO: 4361 - protein, 171 aa, Streptococcus pneumoniae
  misc_feature (B) LOCATION 1...171
  hypothetical: YES
YNERRKLKGFTMSKEVIVESFELDHTIVKAPYVRLIGEETGPKGDIISNYDIRLVQPNEDSIPTAGLHTIEHLLAKLIRTRIDGMIDCSPFGCRTGFHMIMWGRHTSAKIAAVIKDSLKEIAETTTWEDVPGTTIESCGNYKDHSLFSAKEWAKLILEQGISDDAFERHVI

SEQ ID NO: 4362 - protein, 107 aa, Streptococcus pneumoniae
  misc_feature (B) LOCATION 1...107
  hypothetical: YES
STERSKDWAYCKPEYWVTDTSKRSHHTDFDPLDSSVIDFHTVSTFFFKRKSNPHDWSSYVWMSVEELKVTLKSSDLIFFFSIEFFDSWNECISPAQVLHPFKVPRPL

SEQ ID NO: 4363 - protein, 74 aa, Streptococcus pneumoniae
  misc_feature (B) LOCATION 1...74
  hypothetical: YES
KTEREAHGRRLKIIQQQSATIDSLTNELALLREQVAYLTQKLYGKSSEKSVCPSGQLNLFEEESPSEEDGDVPS

SEQ ID NO: 4364 - protein, 105 aa, Streptococcus pneumoniae
  misc_feature (B) LOCATION 1...105
  hypothetical: YES
KEESWDLNKQKISNLLGLAQRAGRIISGEELVVKAIQDGKAKLVFLAHDAGPNLAKKIQDKSHYYQVEIVTVFSTLELSIAVGKSRKVLAVTDAGFTKKMRSLME

SEQ ID NO: 4365 - protein, 262 aa, Streptococcus pneumoniae
  misc_feature (B) LOCATION 1...262
  hypothetical: YES
GKERTMKKFANLYLGLVLYGLYLPIFYLIGYAFNAGDDMNSFTGFSWTHFETMFGDGRLMLILAQTFFLAFLSALIATIIGTFGAIYIYQSRKKYQEAFLSLNNILMVAPDVMIGASFLILFTQLKFSLGFLTVLSSHVAFSIPIVVLMVLPRLKEMNGDMIHAAYDLGASQFQMFKEIMLPYLTPSIITGYFMAFTYSLDDFAVTFFVTGNGFSTLSVEIYSRARKGISLEINALSALVFLFSIILVVGYYFISREKEEQA

SEQ ID NO: 4366 - protein, 453 aa, Streptococcus pneumoniae
  misc_feature (B) LOCATION 1...453
  hypothetical: YES
KEERMKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRXYISQAGSLRASTSQQNETIASQNAAASQTQAEIGNLISQTEAKIRDYQTAKSAMETGASLASQNLAYSLYQSYKSQGEENPQTKVQAVAQVEAQISQLESSLATYRVQYAGSATQQAYASGLSSQLESLKSQHLAKVGQELTLLAQKYLEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 4367 - protein, 235 aa, Streptococcus pneumoniae
  misc_feature (B) LOCATION 1...235
  hypothetical: YES
NDWRNLMIFRVKVNSSVSRPVTVEDICPNCKKPTNPDLVNSSYFSLGENKTSLVLTCRCLGCKHFWTEEFIATRFLINDYTEKYEIEHIKVIPNLPSDIPISDDVEIVSPIGKQIYVQALKAEHEQLDHIAGIGYRKALEFFVKDFSIVTNPDDEDKIIKMSLKQVIEKYIKDEDLKTFALASAYIGNDEGHYYRNNPDKGFTDLKNYLHGVIHYMEMKLNFLDAQELVNRSKKS

SEQ ID NO: 4368 - protein, 287 aa, Streptococcus pneumoniae
  misc_feature (B) LOCATION 1...287
  hypothetical: YES
QRWRISMTWKIIADSGCDYRQLPTPAINTTFVSVPLTIQVADQVFVDDASLDIDQMMETMYATAEASKSACPSPDDYLRAFEGAKNIFLVTITGTLSGSHNSAQLAKNIYLEDHPDTKIHVIDSLSAGGEVDLLVEKLNDLIDQGLSFEEVVEAITAYQEKTKLLFVLAKVDNLVKNGRLSKLIGTVVGLLNIRMVGKASETGTLELLQKARGSKKSVQAAYDELVKAGYAGGRIVMAQRNNEKCCQQLSERIRETFPQADIKILPTSGLCSFYAEDGGLLMGYEID

SEQ ID NO: 4369 - protein, 606 aa, Streptococcus pneumoniae
  misc_feature (B) LOCATION 1...606
  hypothetical: YES
KGWRNLMVLQRNEINEKDTWDLSTIYPTDQAWEEALKDLTEQLETVAQYEGHLLDSADNLLEITEFSLEMERQMEKLYVYAHMKNDQDTREAKYQEYYAKAMTLYSQLDQAFSFYEPEFMEISEKQYADFLEAQPKLQVYQHYFDKLLQGKDHVLSQREEELLAGAGEIFGSASETFSILDNADIVFPYVLDDDGKEVQLSHGTYTRLMESKKREVRRGAYQALYATYEQFQHTYAKTLQTNVKVQNYRAKVRNYKSARHAALAANFVPESVYDNLVAAVRKHLPLLHRYLELRSKILGISDLKMYDVYTPLSSVEYSFTYQEALKKAEDALAVLGEDYLSRVKRAFSERWIDVYENQGKRSGAYSGGSYDTNAFMLLNWQDNLDNLFTLVHETGHSMHSSYTRETQPYVYGDYSIFLAEIASTTNENILTEKLLEEVEDDATRFAILNNFLDGFRGTVFRQTQFAEFEHAIHQADQNGEVLTSDFLNKLYADLNQEYYGLSKEDNPEIQYEWARIPHFYYNYYVYQYSTGFAAASALAEKIVHGSQEDRDRYIDYLKAGKSDYPLNVMRKAGVDMEKEDYLNDAFAVFERRLNEFEALVEKLGLA

SEQ ID NO: 4370 - protein, 586 aa, Streptococcus pneumoniae
  misc_feature (B) LOCATION 1...586
  hypothetical: YES
ICRRKCGIIYHTIRRSAILRRCSMRHKLNLKDWLIRLGLIWFLVTFIIYPNFDLVVNVFVKGGEFSLDAVHRVLKSQRALQSIMNSFKLAFSLIITVNVVGILCVLFTEYFDIKGAKILKLGYMTSLIYGGVVLATGYKFVYGPYGLITKFLQNVIPSLDPNWFIGYGAVLFIMTFSGTANHTLFLTNTIRSVDYHTIEAARNMGAKPFTVFRKVVLPTLIPTLFALTIMVFLSGLSAVAAPMIVGGKEFQTINPMIITFAGMGNSRDLAALLAIILGIATTILLTIMNKIEKGGNYISISKTKAPLKKQKIASKPWNIIAHIVAYGLFTVFMLPLIFIVLYSFTDPVAIQTGNLTLSNFTLENYRLFFSNSAAFSPFLVSFIYSIIAATTATILAVVFARVVRKHKSRFDFLFEYGALLPWLLPSTLLAVSLLFTFNQPQFLVLNQILVGSLVILLIAYIVVKIPFSYRMVRAILFSVDDEMEDAARSMGASPFYTMMKVIIPFILPVVLSVIALNFNSLLTDFDLSVFLYHPLAQPLGITIRSAGDETATSNAQALVFVYTIVLMIISGTVLYFTQRPGRKVRK

SEQ ID NO: 4371 - protein, 411 aa, Streptococcus pneumoniae
  misc_feature (B) LOCATION 1...411
  hypothetical: YES
LKRRKKEERVLLIGVELQGMDSFDLSMEELASLAKTAGAVVVDSYRQKREKYDSKTFVGSGKLEEIALMVDAEEITTVIVNNRLTPRQNVNLEEVLGVKVIDRMQLILDIFAMRARSHEGKLQVHLAQFKYLLPRLVGQGIMLSRQAGGIGSRGPGESQLELNRRSVRNQITDIERQLKVVEKNRATVREKRLESSTFKIGLIGYTNAGKSTIMNILTSKTQYEADELFATLDATTKSIHLGGNLQVTLTDTVGFIQDLPTELVSSFKSTLEESKHVDLLVHVIDASNPYHEEHEKTVLSIMKDLDMEDIPHLTLYNKADLVEDFTPTQTPYTLISAKSEDSRENLQALLLDKIKEIFEAFTLRVPFSKSYKIHDLESVAILEERDYQEDGEVITGYISEKNKWRLEEFYD

SEQ ID NO: 4372 - protein, 448 aa, Streptococcus pneumoniae
  misc_feature (B) LOCATION 1...448
  hypothetical: YES
SFRRRSSKRMKHTLETINSRTQWFREARFGMFIHWGLYSIPGKGEWIRSHQKLSIEDYEPYFRAFDPKEYNPREWAKQAKAAGMKYMVLTAKHHDGFCLFDSKFTDYKATNTPAGRDLVKEFVDAVRAEGLKVGLYFSLIDWHHPDFPKYADLNHPMRGNEAYRDEKINFDSYLEYLHNQVKEIVTGYGQIDILWFDYSYEDMVGEKWGASKLIDMVRHYQPNVIVDNRLETSGEGFGSIVTDEITSYAGDFVSPEQIVPHEGIRNFKGEPVPWELCLTMNNNWAYNPTDYLYKSSQTLIRKLVECVSKNGNMILNVGPDALGRINDSSKKILDNFHRWMSRNGEAIYGCSGDENLPKPDWGYYTRNGNTVYAHVFEQPIGPLALLGISKENVKRMSFLHDGSEVKISESWTTNAYKGICFAQFGEVPHFTYPLPDLIDSVIKIELRE

SEQ ID NO: 4373 - protein, 217 aa, Streptococcus pneumoniae
  misc_feature (B) LOCATION 1...217
  hypothetical: YES
YNRSMITIVLLILAYLLGSIPSGLWIGQVFFQINLREHGSGNTGTTNTFRILGKKAGMATFVIDFFKGTLATLLPIIFHLQGVSPLIFGLLAVIGHTFPIFAGFKGGKAVATSAGVIFGFAPIFCLYLAIIFFGALYLGSMISLSSVTASIAAVIGVLLFPLFGFILSNYDFLFIAIILALASLIIIRHKDNIARIKNKTENLVPWGLNLTHQDPKK

SEQ ID NO: 4374 - protein, 653 aa, Streptococcus pneumoniae
  misc_feature (B) LOCATION 1...653
  hypothetical: YES
TNRRFLVSKKEININNYNDDAIQVLEGLDAVRKRPGMYIGSTDGAGLHHLVWEIVDNAVDEALSGFGDRIDVTINKDGSLTVQDHGRGMPTGMHAMGIPTVEVIFTILHAGGKFGQGGYKTSGGLHGVGSSVVNALSSWLEVEITRDGAVYKQRFENGGKPVTTLKKIGTAPKSKTGTKVTFMPDATIFSTTDFKYNTISERLNESAFLLKNVTLSLTDKRTDEAIEFHYENGVQDFVSYLNEDKEILTPVLYFEGEDNGFQVEVALQYNDGFSDNILSFVNNVRTKDGGTHETGLKSAITKVMNDYARKTGLLKEKDKNLEGSDYREGLAAVLSILVPEEHLQFEGQTKDKLGSPLARPVVDGIVADKLTFFLMENGELASNLIRKAIKARDAREAARKARDESRNGKKNKKDKGLLSGKLTPAQSKNPAKNELYLVEGDSAGGSAKQGRDRKFQAILPLRGKVINTAKAKMADILKNEEINTMIYTIGAGVGADFSIEDANYDKIIIMTDADTDGAHIQTLLLTFFYRYMRPLVEAGHVYIALPPLYKMSKGKGKKEEVAYAWTDGELEELRKQFGKGATLQRYKGLGEMNADQLWETTMNPETRTLIRVTIEDLARAERRVNVLMGDKVEPRRKWIEDNVKFTLEEATVF

SEQ ID NO: 4375 - protein, 329 aa, Streptococcus pneumoniae
  misc_feature (B) LOCATION 1...329
  hypothetical: YES
PCRRYRYSPRRIGTFNFPKEKNGVIMATKQKEVTTFDVQVAEFIRNHKQKGTATDDEINASLVIPFTLDADGIEDLLQRIQDAGISITDNEGNPSARVLSNEEEPELSDEDLIGSTSAKVNDPVRMYLKEIGVVPLLTNEEEKELALAVEAGDIEAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMDMTPDKVREILKIAQEPVSLETPIGEEDDSHLGDFIEDEVIENPVDLIRLVSSCVSNWMKS

SEQ ID NO: 4376 - protein, 460 aa, Streptococcus pneumoniae
  misc_feature (B) LOCATION 1...460
  hypothetical: YES
NSRSRNGVRDMKVIDQFKNKKVLVLGLAKSGESAARLLDKLGAIVTVNDGKPFEDNPAAQSLLEEGIKVITGGHPLELLDEEFALMVKNPGIPYNNPMIEKALAKGIPVLTEVELAYLISEAPIIGITGSNGKTTTTTMIGEVLTAAGQHGLLSGNIGYPASQVAQTASDKDTLVMELSSFQLMGVQEFHPEIAVITNLMPTHIDYHGSFSEYVAAKWNIQNKMTAADFLVLNFNQDLAKDLTSKTEATVVPFSTLEKVDGAYLEDGQLYFRGEVVMAANEIGVPGSHNVENALATIAVAKLRGVDNQTIKETLSAFGGVKHRLQFVDDIKGVKFYNDSKSTNILATQKALSGFDNSKVVLIAGGLDRGNEFDELVPDIPGLKKMVILGQSAERVKRAADKAGVAYVEATDIADATRKAYEIATQGDVVLLSPANASWDMYANFEVRGDLFIDTVAELKE

SEQ ID NO: 4377 - protein, 84 aa, Streptococcus pneumoniae
  misc_feature (B) LOCATION 1...84
  hypothetical: YES
IFRRIKEMTEKEIFDRIVTIIQERQGEDFVVTESLSLKDDLDADSVDLMEFILTLEDEFSIEISDEEIDQLQNVGDVVKIIQGK

SEQ ID NO: 4378 - protein, 287 aa, Streptococcus pneumoniae
  misc_feature (B) LOCATION 1...287
  hypothetical: YES
IIRRLDCIAYCLSIKYILLEAFTQMAKEKYDRSKPHVNIGTIGHVDHGKTTLTAAITTVLARRLPSSVNQPKDYASIDAAPEERERGITINTAHVEYETEKRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDSKYEDIVMELMNTVDEYIPEPERDTDKPLLLPVEDVFSITGRGTVASGRIDRGIVKVNDENYIVGIKEENLEPLVSGC

SEQ ID NO: 4379 - protein, 161 aa, Streptococcus pneumoniae
  misc_feature (B) LOCATION 1...161
  hypothetical: YES
RKRRKEMTEKRLAWDEYFAAQALLIANRSTCKRAKVGAILVKDNKVISTGYNGSVSGTEHCIDHECLVIEGHCVRTLHAEVNAILQGAERGVPKGFTAYVTHFPCFNCTKQLLQVGCKRVVYINQYRMDDYAQYLYQEKGTELTHLPLETVQTALKEADLM

SEQ ID NO: 4380 - protein, 164 aa, Streptococcus pneumoniae
  misc_feature (B) LOCATION 1...164
  hypothetical: YES
SRRSWMEIKNHFGVYCVCFENGKLLCIEKTRGPYQHRYDLPGGSQQLGEGLTETLTREVMEETGFTVRSYSNPRIYDVFVREELKNFMVHHVMALYDVEMNESAPQVTISEAVSDGANDSLGYIWMDIQEITEENASPLVLKVKSELLGFPELDKTSYMNWKVK

SEQ ID NO: 4381 - protein, 60 aa, Streptococcus pneumoniae
  misc_feature (B) LOCATION 1...60
  hypothetical: YES
FLGSYFYFFKKLSSCILYSMKIKEQARKLAVGCSKHCFEVVDKTDKVRNTYLRQGDVDAV

SEQ ID NO: 4382 - protein, 180 aa, Streptococcus pneumoniae
  misc_feature (B) LOCATION 1...180
  hypothetical: YES
ETGRNKMTDYYVIGDVHGKAGMLEDLLKTWDGQTQLLFLGDLIDRGEDSHRVLEMVKDLVDNQGAICLSGNHEYMFLTWLDYPEESYDHYRRNGGDTTIKSILGRPLDAPVDGVEDAKRVAAEAADLVEFIRQMPFVVETDKYIFVHAGIDLTLDDWHETTDYKKVWLRRPFHGGANYTG

SEQ ID NO: 4383 - protein, 147 aa, Streptococcus pneumoniae
  misc_feature (B) LOCATION 1...147
  hypothetical: YES
RGGSCRLTSRVFIDADCISVFLWVGTEHLLEKLYLGKIVIPQEVYDEINIPTIPHLKSRIDQLVTKGSAEIVSIDIGTEEYALYRDLTRNHDSNKIIGKGEATSIFLAKKHNGILGSNNLRDVKPYVEEFSLEHMTTGDILIEAFKA

SEQ ID NO: 4384 - protein, 156 aa, Streptococcus pneumoniae
  misc_feature (B) LOCATION 1...156
  hypothetical: YES
TSFGSGHPVMIPSTPAGIMEMFHEYGIDLEGKNAVVIGRSNIVGKPMAQLLLAKNATVTLAHSRTHNLAKVAAKADILVVAIGRAKFVTADFVKPGAVVIDVGMNRDENGKLCGDVDYEAVAPLASHITPVPGGVGPMTHYHADGANLSSSTSDIG

SEQ ID NO: 4385 - protein, 181 aa, Streptococcus pneumoniae
  misc_feature (B) LOCATION 1...181
  hypothetical: YES
ETFGGISIMAKQTIIVMSDSHGDSLIVEEVRDRYVGKVDAVFHNGDSELRPDSPLWEGIRVVKGNMDFYAGYPERLVTELGSTKIIQTHGHLFDINFNFQKLDYWAQEEEAAICLYGHLHVPSAWMEGKILFLNPGSISQPRGTIRECLYARVEIDDSYFKVDFLTRDHEVYPGLSKEFSR

SEQ ID NO: 4386 - protein, 300 aa, Streptococcus pneumoniae
  misc_feature (B) LOCATION 1...300
  hypothetical: YES
SGFGCDQAKPRGNYRGTKMKIAYLGPKGSFSHHVVQTAFPHEELQAFANITDVIKAYEQGLVDYSVVPVENSIEGSVHETLDYLFHQAHIQAVAEIVQPIHQQLMVVPGHTKIEKIFSHPQGLAQGKKFIDEQYPEAQIEVTASTAYAARFISEHPDQPFAAVAPRSSAEEYGLELIAEDIQEMEANFTRFWVLGAEKPSIPLQAQTEKMSLALTLPDNLPGALYKALSTFAWRGIDLTKIESRPLKTALGEYFFIIDVDYIDKDLVHFAQKELEAIGIQYKILGAYPIYPISDHGKERR

SEQ ID NO: 4387 - protein, 251 aa, Streptococcus pneumoniae
  misc_feature (B) LOCATION 1...251
  hypothetical: YES
KVFGGGRIMLNQDLFDSLEAQKIVDTLMKGQKDYVDERLEKRETMIVSNGYAWTRPNHIDTAFASADLFEYKLQLAGQTWGYLEFETNTEKYGKVLLIIKGKKRLTNQFPLVQKNKSGYLFEYAQMNTLYLNQHSSYKNDEDSHSFPIQMELVSDEMIQEIEQATKNSNIEKFMILTYEADSENNIISVDVVMPDARTGQLHLIQDLSEYIQSSSYHFEEAKYQDIPNFSELSETEDFEIIPRIEKQEGQK

SEQ ID NO: 4388 - protein, 63 aa, Streptococcus pneumoniae
  misc_feature (B) LOCATION 1...63
  hypothetical: YES
RKFGIYLLIINRFFSLFVLDWYRTELWINTLVSYPVPKYVGRKMKQLLRVSVLEKILSIEFFK

SEQ ID NO: 4389 - protein, 63 aa, Streptococcus pneumoniae
  misc_feature (B) LOCATION 1...63
  hypothetical: YES
KILGWDITRNSILLKDITIAYFSNSFFDQFLINWIAWSWLRIWCRLRTWTRFWSRLWTWFFWS

SEQ ID NO: 4390 - protein, 63 aa, Streptococcus pneumoniae
  misc_feature (B) LOCATION 1...63
  hypothetical: YES
KILGWDITRNSILLKDITIAYFSNSFFDQFLINWIAWSWLRIWCRLQTWTRFRSRLWTWLFWS

SEQ ID NO: 4391 - protein, 637 aa, Streptococcus pneumoniae
  misc_feature (B) LOCATION 1...637
  hypothetical: YES
GNLGEIEKVRMKKKLTSLALVGAFLGLSWYGNVQAQESSGNKIHFINVQEGGSDAIILESNGHFAMVDTGEDYDFPDGSDSRYPWREGIETSYKHVLTDRVFRRLKELGVQKLDFILVTHTHSDHIGNVDELLSTYPVDRVYLKKYSDSRITNSERLWDNLYGYDKVLQTAAEKGVSVIQNITQGDAHFQFGDMDIQLYNYENETDSSGELKKIWDDNSNSLISVVKVNGKKIYLGGDLDNVHGAEDKYGPLIGKVDLMKFNHHHDTNKSNTKDFIKNLSPSLIVQTSDSLPWKNGVDSEYVNWLKERGIERINAASKDYDATVFDIRQDGLVHIFTSYKPIPSFQAGWHKSAYGNWWYQAPDSTGEYAVGWNEIEGEWYYFNQTGILLQNQWKKWNNHWFYLTDSGASAKNWKKIDGIWYYFNKENQMEIGWVQDKEQWYYLDVDGSMKTGWLQYMGQLYYFAPSGEMKTGWVKDKEAWYYMDSTGIMKTGEIEVAGHHYYLEESGAMKQGWLKKANDWYFYKTGGSRAIGWIKDKDKWYFLKENGQLLVNGKTPEGYTVDSSGAWLVDVPIEKSATIKTTSHSEIKESKEVVKKDLENKETSQHESVTNSSTSQDLTSSTSQSSETSVNKSESEQ

SEQ ID NO: 4392 - protein, 80 aa, Streptococcus pneumoniae
  misc_feature (B) LOCATION 1...80
  hypothetical: YES
HMIGSIAAILTTFAFLPQVFRVVKTKDTGSIALGMYVMQVIGIALWLAHGIRIGDLPLILANSVSFLLSGIILFYKLKYK

SEQ ID NO: 4393 - protein, 80 aa, Streptococcus pneumoniae
  misc_feature (B) LOCATION 1...80
  hypothetical: YES
LCVGYLPYTLISFLLFNLSVLVYQKVLGLSACDGCLSDFLHSFTKVSISRKRCKCVCLNSIISFTSSLVSMNFPPLSFYS

SEQ ID NO: 4394 - protein, 236 aa, Streptococcus pneumoniae
  misc_feature (B) LOCATION 1...236
  hypothetical: YES
KDVGMKELQTVLKNHFAIEFTDKKLLETAFTHTSYANEHRLLKISHNERLEFLGDAVLQLLISEYLYKKYPKKPEGDLSKLRAMIVREESLAGFARDCQFDQFIKLGKGEEKSGGRNRDTILGDAFEAFLGALLLDKDVAKVKEFIYQVMIPKVEAGEFEMITDYKTHLQELLQVNGDVAIRYQVISETGPAHDKVFDVEVLVEGKSIGQGQGRSKKLAEQEAAKNAVEKGLDSCI

SEQ ID NO: 4395 - protein, 368 aa, Streptococcus pneumoniae
  misc_feature (B) LOCATION 1...368
  hypothetical: YES
ELVGGVMKKIGTYLVYVLAVVFIMLAFACGTIAFAELGYSAVLAFTFGYAFALLSMYLIFILHELGHAFCGYLTGYRLVAFGLGHFILTKKSGRFHLSRTAILKNVGAQYIGLKEDESDQRIILMLSGGLMVHLGLILLAIVFGFLTRSWYFAGTWIFLNLSFFLNNILSVDITDGAKIWELLQHPENTKYAYLVLRHSAQTLLAPQEYDLKDFVQAVPEDARGSFADGVLGMQGEVSILEGKEEVAKQQFQALLERTTTPMMQTVAQLSLLHIALLEGDFEQAEQYASIRQVKSFLSLKLSNLQVIQAWYQFKVRKDVVQTHKAMKIARQKMDSSRMLRDEKRYYENLLAELEKEMLEGTEDGTRNF

SEQ ID NO: 4396 - protein, 232 aa, Streptococcus pneumoniae
  misc_feature (B) LOCATION 1...232
  hypothetical: YES
LVVGIATPATQRLASATKDLPVIMAAITDPIGANLVKDLKKPGGNVTGVSDHNPAQQQIELIKALTPNVKTIGALYSSSEDNSKTQVEEFKAYAEKAGLTVETFAVPSTNEIASTVTVMTSKVDAIWVPIDNTIASGFPTVVSSNQSSKKPIYPSATAMVEVGGLASVVIDQHDLGVATGKMIVQVLKGAKPADTPVNVFSTGKSVINKKIAQELGITIPESVLKEAGQVIE

SEQ ID NO: 4397 - protein, 159 aa, Streptococcus pneumoniae
  misc_feature (B) LOCATION 1...159
  hypothetical: YES
HISGQTKVSSWRRTFAIKDDRGEIAYQVEGSFLKIPKTFTIYDAAGEQVSQISKEILTLLPRFEIQLRDGSSFVIRKKLTFWRDKYEFDNLGLRIEGNIWDLNFKLLDDRDQLIAEIKKELFHLTSTYTVTVLEDAYADLVISLCVAIDYVEMLESQSH

SEQ ID NO: 4398 - protein, 178 aa, Streptococcus pneumoniae
  misc_feature (B) LOCATION 1...178
  hypothetical: YES
NHSGSWMKVKYRLCLKIQTFPPANREYFRGGGFSTRFLTKGDMPVTMVRLNLLKGVGPVLQIAEGYTLELPEDVHHTLDNRTDPGWPTTWFAPRLTGKGAFKSVYDVMNNWGANHGAITYGHIGADLITLASMLRIPVNMHNVPEEDIFRPKNWSLFGTEDLESADYRACQLLGPLHK

SEQ ID NO: 4399 - protein, 1290 aa, Streptococcus pneumoniae
  misc_feature (B) LOCATION 1...1290
  hypothetical: YES
APSGTASVLVRFAFQAQTVAADGVTTTTENQPTIHTVSDSPQSSENRTEETPKAELQPETPATDKVASLPKTEEKPQEEVSSTPSDKAEVVTPTSAEKETANKKAEEASPKKEEAKEVDSKESNTDKTDKDKPAKKDEAKAEADKPETEAGKERAATVNEKLAKKKIVSIDAGRKYFSPEQLKEIIDKAKHYGYTDLHLLVGNDGLRFMLDDMSITANGKTYASDDVKRAIEKGTNDYYNDPNGNHLTESQMTDLINYAKDKGIGLIPTVNSPGHMDAILNAMKELGIQNPNFSYFGKESARTVNLDNEQAVAFTKALIDKYAAYFAKKTEIFNIGLDEYANDATDAKGWSVLQADKYYPNEGYPVKGYEKFIAYANDLARIVKSHGLKPMAFNDGIYYNSDTSFGSFDKDIIVSMWTGGWGGYDVASSKLLAEKGHQILNTNDAWYYVLGRNADGQGWYNLDQGLNGIKNTPITSVPKTEGADIPIIGGMVAAWADTPSARYSPSRLFKLMRHFANANAEYFAADYESAEQALNEVPKDLNRYTAESVAAVKEAEKAIRSLDSNLSRAQQDTIDQAIAKLQETVNNLTLTPEAQKEEEAKREVEKLAKNKVISIDAGRKYFTLNQLKRIVDKASELGYSDVHLLLGNDGLRFLLDDMTITANGKTYASDDVKKAIIEGTKAYYDDPNGTTLTQAEVTELIEYAKSKDIGLIPAINSPGHMDAMLVAMEKLGIKNPQAHFDKVSKTTMDLKNEEAMNFVKALIGKYMDFFAGKTKIFNFGTDEYANDATSAQGWYYLKWYQLYGKFAEYANTLAAMAKERGLQPMAFNDGFYYEDKDDIQFDKDVLISYWSKGWWGYNLASPQYLASKGYKFLNTNGDWYYILGQKPEDGGGFLKKAIENTGKTPFNQLASTKYPEVDLPTVGSMLSIWADRPSAEYKEEEIFELMTAFADHNKDYFRANYNALREELAKIPTNLEGYSKESLEALDAAKTALNYNLNRNKQAELDTLVANLKAALQGLKPAATHSGSLDENEVAANVETRPELITRTEEIPFEVIKKENPNLPAGQENIITAGVKGERTHYISVLTENGKTTETVLDSQVTKEVINQVVEVGAPVTHKGDESGLAPTTEVKPRLDIQEEEIPFTTVTRENPLLLKGKTQVITKGVNGHRSNFYSVSTSADGKEVKTLVNSVVAQEAVTQIVEVGTMVTHVGDENGQAAIAEEKPKLEIPSQPAPSTAPAEESKALPQDPAPVVIEKKLPETGTHDSAGLVVAGLMATLAAYGLTKRKED

SEQ ID NO: 4400 - protein, 118 aa, Streptococcus pneumoniae
  misc_feature (B) LOCATION 1...118
  hypothetical: YES
DKSGGRNFNERYRRSGFNKGNDGSYYCKVMKLDEKITLVLLIWNVIIFLIYGIDKFKARRRAWRIPEKILLILALTCGGFGAWLAGITFHHKTRKWYFKTVWFLGMVTTLVALYFIWR

SEQ ID NO: 4401 - protein, 741 aa, Streptococcus pneumoniae
  misc_feature (B) LOCATION 1...741
  hypothetical: YES
ERAGFMYLKEIEIQGFKSFADKTKVVFDQGVTAVVGPNGSGKSNITESLRWALGESSVKSLRGGKMPDVIFAGTESRKPLNYASVVVTLDNHDGFIKDAGQEIRVERHIYRSGDSEYKIDGKKVRLRDIHDLFLDTGLGRDSFSIISQGKVEEIFNSKPEERRAIFEEAAGVLKYKTRRKETESKLQQTQDNLDRLEDIIYELDNQIKPLEKQAENARKFLDLEGQRKAIYLDVLVAQIKENKAELESTEEELAQVQELLMSYYQKREKLEEENQTLKKQRQDLQAEMAKDQGSLMDLTSLISDLERKLALSKLESEQVALNQQEAQARLAALEDKRNSLSKEKYDKESSLALLEGNLVQNNQKLNRLEAELLAFSDDPDQMIELLRERFVALLQEEADVSNQLTRIENELENSRQLSQKQADQLEKLKEQLATAKEKASQQKDELETAKVQVQKLLADYQAIAKEQEEQKTSYQAQQSQLFDRLDSLKNKQARAQSLENILRNHSNFYAGVKSVLQEKDRLGGIIGAVSEHLTFDVYYQTALEIALGASSQHIIVEDEESATKAIDFLKRNRVGRATFLPLTTIKARTISSQNQDAIAVSPGFLGMADELVTFDTRLEAIFKNLLATTAIFDTVEHAREAARQVRYQVRMVTLDGTELRTGGSYAGGANRQNNSIFIKPELEQLQKEIAADEASLGSEEAALKTLQDQMAALTERLEAIKLSRRAGTYSGARLVPRLSAN

SEQ ID NO: 4402 - protein, 78 aa, Streptococcus pneumoniae
  misc_feature (B) LOCATION 1...78
  hypothetical: YES
LPHGCLFMKDGKMSKSKGNVVYPEMLVGALWTRSTLLLTSCVTFQLFQTDPLLLKTMLAVSTMNWLMTLGTSLTVRFP

SEQ ID NO: 4403 - protein, 71 aa, Streptococcus pneumoniae
  misc_feature (B) LOCATION 1...71
  hypothetical: YES
HQHGVTVIVAQTFDFLNNSWEAAASGTRPMVDGEITHSTGSPSGYFNVLEIKSATLLAMFIVCTSSDSRTP

SEQ ID NO: 4404 - protein, 383 aa, Streptococcus pneumoniae
  misc_feature (B) LOCATION 1...383
  hypothetical: YES
MFNGRVLKELRLLNGLSRAELAQRINLTEQAIWQFESNETKPKLSTKMHLANQFHVDLTYFEQEEESIRFDSSVIAFRNADLATRKTIDIQTMYLHKVDSLIDYFESFVIIPNIIIHDLSNVVSESYHKGESIEELALYAREKLGISKDNHDLLYKLERSGIYIVERLINGQADAYSAWSKLGRPYIVLGTNKSSVRRNFDLAHELGHILLHKYKDMNEDGDRLEQEANYFASCFLLPKEEFLVKFEERVGKRVSNPDSYILLKSDLNVSIQALEYRAFKLGLLTPKQHSYFYRQIAQKGYKMIEPLDDQIFVKKPSKVKSILDVVLSNHLVSLATIMSKQSIRLQFISEIFSVEMKFFDQYQEDRRTDRFDNIIPLYKRNNL

SEQ ID NO: 4405 - protein, 105 aa, Streptococcus pneumoniae
  misc_feature (B) LOCATION 1...105
  hypothetical: YES
FPNGSFLRALNISHFGRSTVKRQSALVVFSGGQDSTTCLFSGPRQYETVEAVTFGLRQHHHLEIQIAREIAKEQGHSSPISSICLCWDKSLLNHDFATISYFLHF

SEQ ID NO: 4406 - protein, 134 aa, Streptococcus pneumoniae
  misc_feature (B) LOCATION 1...134
  hypothetical: YES
KENGTIFLRENTMGGKMRLLPIRKISRQSKRLALFLTFCAGYVDAYTFIVRGNTLVAGQTGNVVFLSVELIKNNVSDVRDKVLTLLAFMMGVFLLTIYKEKLRIVKKPILSLIPLAILSIIIAFVPQTVDNIYL

SEQ ID NO: 4407 - protein, 327 aa, Streptococcus pneumoniae
  misc_feature (B) LOCATION 1...327
  hypothetical: YES
RVNGRNKMSDVKEEVSSLSEKQLRQIDVEYAELNDSDIIERLAYLEINNNEKRIVISDIEPTKEIMSVSDQIFEIQKNFQKIKNMFELFISDVSDFLSIKNKLESKELEIEEADVNRFMIHLLSSGKLFVDFNENQIKQKYSKDSEEFDCIHGFASYQYDINFTYRFCHSLRNYSQHTDLPINEVKAVSPDDETVIIDFYIDLDYLLNSNFKWKKLKGELIKLNQETSKIDAIALVKEYFNALTELYGNYNKLFLKLNHNTLVDIKSKLESLKLKHSRYYISKISKYDLKYNPGNYTMSPLAAFAEIEEIYIELSKIGLVKIVNKSN

SEQ ID NO: 4408 - protein, 172 aa, Streptococcus pneumoniae
  misc_feature (B) LOCATION 1...172
  hypothetical: YES
AGNGHRKGFPESYDMEALLNFLDRIKNGQDVDIPVYSHEVYDIVPKKKQSVKAADFVIVEGINVFQNPQNDRLYITDFFDFSIYVDAGVDDIESWYLDRFLKMLSLAQNDPDSYYYRFTQMPIGEVESFAHQVWTSINLTNLQNYIEPTRNRAEVILHKSKNHEIDEIYLKK

SEQ ID NO: 4409 - protein, 251 aa, Streptococcus pneumoniae
  misc_feature (B) LOCATION 1...251
  hypothetical: YES
SRDGRNPERKFAIITGLNLPMLIQAYTERLMDAAAGVEKVAANIIKEAKDGIKALPEELNPVEEVASAAAAPVAQAAIPEGTVIGDGKLKINLARLDTRLLHGQVATAWTPDSKANRIIVASDNVAKDDLRKELIKQAAPGNVKANVVPIQKLIEISKDPRFGETHALILFETPQDALRAIEGGVPIKTLNVGSMAHSTGKTLVNTVLSMDNADVATFXKMRDLGVTFDVRKVPNDSKKDXFDLLNKANVK

SEQ ID NO: 4410 - protein, 68 aa, Streptococcus pneumoniae
  misc_feature (B) LOCATION 1...68
  hypothetical: YES
SKDGKKKENQIEKLPLYLEKLLKLSTLKSSVGQSENVLEKGASKRFILPTMLNSLMKTIASARSRNQA

SEQ ID NO: 4411 - protein, 68 aa, Streptococcus pneumoniae
  misc_feature (B) LOCATION 1...68
  hypothetical: YES
SKDGKKKENQIEKLPLYLEKLLKLSTLKSSVGQSENVLEKGASKRFILPTMLNSLMKIIASTRSRDQA

SEQ ID NO: 4412 - protein, 97 aa, Streptococcus pneumoniae
  misc_feature (B) LOCATION 1...97
  hypothetical: YES
RNCGLPNCIIEIIAQICYDINMNKSRLGRGRHGKTRHVLLALIGILAISICLLGGFIAFKIYQQKSFEQKIESLKKEKDDQLSEGNQKEHFRQGKPK

SEQ ID NO: 4413 - protein, 109 aa, Streptococcus pneumoniae
  misc_feature (B) LOCATION 1...109
  hypothetical: YES
RSCGIRLIRLVVENEARCTDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 4414 - protein, 98 aa, Streptococcus pneumoniae
  misc_feature (B) LOCATION 1...98
  hypothetical: YES
APRGETFQEKVSITTYQNNQVSNNKFQTSLHFIEVVSKDLGVDKSEVYVNTSTNTDGALIKVGDRYYRALNGSEPDKYLLEKVELYKTDAIELVDVNK

SEQ ID NO: 4415 - protein, 260 aa, Streptococcus pneumoniae
  misc_feature (B) LOCATION 1...260
  hypothetical: YES
RASGVYHGALSIMIMATYETFAAVYDAVMDDSLYDKWTNFSLRHLPKTKERKKLLELACGTGIQSVRFSQAGFDVTGLDLSADMLKIAEKRATSAKQKIAFIEGNMLNLSKAGKYDFVTCYSDSICYMQDEVEVGDVFKDVYNALNEEGVFIFDVHSTYQTDEVFPGYSYHENAEDFAMLWDTYEDEAPHSIVHELTFFIKEADGSFSRHDEVHEERTYEILTYDILLEQAGFKSFKLYADFEDKEPTETSTRWFFVAQK

SEQ ID NO: 4416 - protein, 114 aa, Streptococcus pneumoniae
  misc_feature (B) LOCATION 1...114
  hypothetical: YES
AKSGFRTSRALVKNVPFGQKLDWFPVHFSKGMKQKVMIICAFVVDPSLFIVDEPFLGLDPLAISDLIQLLEVEKQKGKSILMSTHVLDSAEKMCDAFVILHKGEVRANESPATT

SEQ ID NO: 4417 - protein, 162 aa, Streptococcus pneumoniae
  misc_feature (B) LOCATION 1...162
  hypothetical: YES
VPGGSENIRQVLKINDTENKEAGAYQFVTVGVQHATLAHMIYAWLTPFTDIRSAQETTGGSSDVKFMQINQFYMQTSQNMAKYQGLKTAGKDIELKYFGVYVLNVTDNSTFKGILNISDTVTTVNDQTFDNSKELIDYVSAQKLGDSVKVTYEEDGQTKSAE

SEQ ID NO: 4418 - protein, 99 aa, Streptococcus pneumoniae
  misc_feature (B) LOCATION 1...99
  hypothetical: YES
GGIGGTYGAMPELFLKLNQLIADKDLKTARELQYAINAIIGKLTSAHGNMYGVIKEVLKINEVLNIGSVRSPLTPVTEEGRPVVEAAAALIRETKERFL

SEQ ID NO: 4419 - protein, 193 aa, Streptococcus pneumoniae
  misc_feature (B) LOCATION 1...193
  hypothetical: YES
MKIGILALQGAFAEHAKVLDQLGVESVELRNLDDFQQDQSDLSGLILPGGESTTMGKLLRDQNMLLPIREAILSGLPVFGTCAGLILLAKEITSQKESHLGTMDMVVERNAYGRQLGSFYTEAECKGVGKIPMTFIRGPIISSVGEGVEILATVNNQIVAAQEKNMLVSSFHPELTDDVRLHQYFINMCKEKS

SEQ ID NO: 4420 - protein, 284 aa, Streptococcus pneumoniae
  misc_feature (B) LOCATION 1...284
  hypothetical: YES
GPVGYSLYGGLIMADIKLIALDLDGTLLTTDKRLTDRTKETLKAARDRGIKVVLTTGRPLKAMDFFLHELGTDGQEEEYTITFNGGLVQKNTGEILDKTVFSYDDVARLYEETEKLSLPLDAISEGTVYQIQSDQESLYAKFNPALTFVPVDFEDLSNQMTYNKCVTAFAQEPLDAAIQKISPELFDQYEIFKSREMLLEWSPKNVHKATGLAKLISHLGIDQSQVMACGDEANDLSMIEWAGLGVAMQNAVPEVKAVANVVTPMTNDEEAVAWAIEEYVLKEN

SEQ ID NO: 4421 - protein, 61 aa, Streptococcus pneumoniae
  misc_feature (B) LOCATION 1...61
  hypothetical: YES
FSYGHDSLLNSTYLFYHFFGRELLQKGYKKNKVPFHFQSMADFGEMWYNFSYGKDCHYSNC

SEQ ID NO: 4422 - protein, 130 aa, Streptococcus pneumoniae
  misc_feature (B) LOCATION 1...130
  hypothetical: YES
RKYGIEGNSMEQIGKVFKQLQESRNISLIQATGGQFSPSMLSRFETGQNELSVEKFLFALENISASVEEILFLARGFHYDTNPELRKEITDVLEPKNIPPLEDLYRREYQKHAHSHNKQKHILNAIIIKS

SEQ ID NO: 4423 - protein, 311 aa, Streptococcus pneumoniae
  misc_feature (B) LOCATION 1...311
  hypothetical: YES
GENGGNRSMIYTVTLNPSIDYIVRXDQVKVGSVNRMDSDDKFAGEKGINVSRVLKRLNISNTATGFIGGFTGKFITDTLAEEEIETRFVQVAEDTRINVKIKADQETEINGTGPTVEPVKLEELKAILSSLTAEDTVVFAGSSAKNLGNVIYKDLISLTRQTGAQVVCDFEGQTLIDSLDYQPLLVKPNNHELGAIFGVKLESLDEIEKYARELLAKGAQNVIISMAGDGALLVTSEGAYFAKPIKGTVKNSVGAGDSMVAGFTGEFVKSKDAVEAFKWGVACGTATTFSDDLATAEFIKETYGKVEVEKR

SEQ ID NO: 4424 - protein, 276 aa, Streptococcus pneumoniae
  misc_feature (B) LOCATION 1...276
  hypothetical: YES
FGNGSSPLSPFKEVSMKKYQRMHLIFIRQYIKQIMEYKVDFVVGVLGDLSGSRLESLVSQCHLSTYSIPRRWTFQEIAFIYGFSLIPKGMDHLFFDNLWALGQRLVRKGEFDKYLTRPINPLFHILVETFQIDALGELLVGGILLGTTVTSIVWTLPKFLLFLVCIPFATLIYTSLKIATASIAFWTKQSGAMIYIFYMFNDFAKYPISIYNSLLRWLISFIVPFAFTAYYPASYFLQEKDVFFNVGGLMLISLVFFVISLKLWDKGLDSYESAGS

SEQ ID NO: 4425 - protein, 204 aa, Streptococcus pneumoniae
  misc_feature (B) LOCATION 1...204
  hypothetical: YES
INDGKNSLNVKSKGLYMSKAKKICFIIFCILILTIFLPVLIDYHQVSDLGIHLLSWRQNSVVEFYLARYVFWGTVVLSTLVLLSILVVMFYPKRYLEIQLETKNDTLKLKNSAIEGFVRSLVSDHRLIKNPTVHVNLRKNKCFVHVEGKILPSDNIADRCQIIQNEITNGLKQFFGIERQVKLEVAVKNYQPKPQNKKTVSRVK

SEQ ID NO: 4426 - protein, 426 aa, Streptococcus pneumoniae
  misc_feature (B) LOCATION 1...426
  hypothetical: YES
SKDGGNAMLGILTFILVFGIIVVVHEFGHFYFAKKSGILVREFAIGMGPKIFAHIGKDGTAYTIRILPLGGYVRMAGWGDDTTEIKTGTPVSLTLADDGKVKRINLSGKKLDQTALPMQVTQFDFEDKLFIKGLVLEEEKTFAVDHDATVVEADGTEVRIAPLDVQYQNATIWGKLITNFAGPMNNFILGVVVFWVLIFMQGGVRDVDTNQFHIMPQGALAKVGVPETAQITKIGSHEVSNWESLIQAVETETKDKTAPTLDVTISEKGSDKQVTVTPEDSQGRYLLGVQPGVKSDFLSMFVGGFTTAADSALRILSALKNLIFQPDLNKLGGPVAIFKASSDAAKNGIENILYFLAMISINIGIFNLIPIPALDGGKIVLNILEAIRRKPLKQEIETYVTLAGVVIMVVLMIAVTWNDIMRLFFR

SEQ ID NO: 4427 - protein, 110 aa, Streptococcus pneumoniae
  misc_feature (B) LOCATION 1...110
  hypothetical: YES
SYCGYDEKIILENINIKIPEEKISVIIGSNGCGKSTLIKTLSRLIKPLEGEVLLDNKSINSYKEKDLAKHIAILPQSPIIPESITVADLVSRGRFPTESLLRVLEKMTLK

SEQ ID NO: 4428 - protein, 63 aa, Streptococcus pneumoniae
  misc_feature (B) LOCATION 1...63
  hypothetical: YES
GRCGVGPGWGGGFLRGGAWGGWRAAGGGGGGGGELLARGGGLAAWRGAACGGTGGGGKWGGRG

SEQ ID NO: 4429 - protein, 71 aa, Streptococcus pneumoniae
  misc_feature (B) LOCATION 1...71
  hypothetical: YES
KESGNNMLNAKIFYIFLCLIVIETTGLLLLKRGLEMGYLDTEAIILAVFSFAFYNLCSFAWVCSTIKNNKK

SEQ ID NO: 4430 - protein, 192 aa, Streptococcus pneumoniae
  misc_feature (B) LOCATION 1...192
  hypothetical: YES
ESGGRISKISEALKRQTTQHYPALILFDGLMYRNIKRDKLTEAEQDYLENHVFITSALYGVVPALSPMAPHRLDFLMKLKVAGKTLKSHWKAVYDEALKMEEVIFSLLSSEFETVFSKEIRAKMVTFNFMEDRERSLKIHSTISKKARGAFLTALIENQVQTVGEARRLNFAGFVYREDLSQPQGLVFVKEV

SEQ ID NO: 4431 - protein, 130 aa, Streptococcus pneumoniae
  misc_feature (B) LOCATION 1...130
  hypothetical: YES
VGGGAGWVAGGFWGWRGAGRLVRWGCGRGAGVGWWRSGGGVRGRGGAVRPVRCGPGVGRRIPAGGGVGGLACGGRWWGWGGGVARARWGIGRVEGGGMRGNGGWREVGWPGLRRGRSGDGWSGVSGGQLV

SEQ ID NO: 4432 - protein, 406 aa, Streptococcus pneumoniae
  misc_feature (B) LOCATION 1...406
  hypothetical: YES
KILGKVVISCYTYSLWYNCKRFNPIIYKERKIFMRDLLSKKSHRQLELLELLFEHKRWFHRSELAELLNCTERAVKDDLSHVKSAFPDLIFHSSTNGIRIINTDDSDIEMVYHHFFKHSTHFSILEFIFFNEGCQAESICKEFYISSSSLYRFISQINKVIKRQFQFEVSLTPVQIIGNERDIRYFFAQYFSEKYYFLEWPFENFSSEPLSQLLELVYKETSFPMNLSTHRMLKLLLVTNLYRIKFGHFMEVDKDSFNDQSLDFLMQAEGIEGVAQSFESEYNISLDEEVVCQLFVSYFQKMFFIDESLFMKCVKKDSYVEKSYHLLSDFIDQISVKYQIEMENKDNLIWHLHNTAHLYRQELFTEFILFDQKGNTIRNFQNIFPKFVSDIKKEISHYLETLEVCS

SEQ ID NO: 4433 - protein, 214 aa, Streptococcus pneumoniae
  misc_feature (B) LOCATION 1...214
  hypothetical: YES
TIIGLIIGLAIGVFRTAPLSENKAIYGLQKLVGWVLNVYIEIFRGTPMIVQSMVIYYGTAQAFGINLDRTLAAIFIVSINTGAYMTEIVRGGILAVDKGQFEAATALGMTHNQTMRKIVLPQVVRNILPATGNEFVINIKDTSVLNVISVVELYFSGNTVATQTYQYFQTFTIIAVIYFVLTFTVTRILRFIERRMDMDTYTTGANQMQTEDLK

SEQ ID NO: 4434 - protein, 120 aa, Streptococcus pneumoniae
  misc_feature (B) LOCATION 1...120
  hypothetical: YES
WMVGSSREHAAWALADYGFKVVIAGSFGDIHYNNELNNGMLPIVQPREVREKLAQLKPTDQVTVDLEQQKIISPVEEFTFEIDSKWKHKLLNSLDDIGITLQYEELIAAYEKQRPAYWQD

SEQ ID NO: 4435 - protein, 140 aa, Streptococcus pneumoniae
  misc_feature (B) LOCATION 1...140
  hypothetical: YES
LQSGSGQLADKSSQLLSGASPLENRANKLADGSRKLAEGGTKLTSGLEDLQTGLASLGQGLGNASDQLKSVSTESKNAEILSNPLNLSKTDNDQVPVNGIAIAPYMISVALFVAAISTNMIFAKLPSGRHPESRWAWLKS

SEQ ID NO: 4436 - protein, 291 aa, Streptococcus pneumoniae
  misc_feature (B) LOCATION 1...291
  hypothetical: YES
KKSGRFWMKLDGYTRLAAVVANPIKHSISPFIHNRAFEATATNGAYVAWEIEASDLVETVANIRRYQMFGINLSMPYKEQVIPYLDXLSDEXRLIGAVNTVVNENGNWIGYNTNGKGFFKCLPSFTISGKKNNLLGARGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 4437 - protein, 109 aa, Streptococcus pneumoniae
  misc_feature (B) LOCATION 1...109
  hypothetical: YES
RKSGAYLNIQHDYNTKGAKMEAVEIVRIKDVIIEKVSANDEELKRIFGCSKRQAGERRREMQKLPSQQKHLLDSGQLVTIKGFYEYLQYRGTKAWKKEMETSKKMRSAG

SEQ ID NO: 4438 - protein, 283 aa, Streptococcus pneumoniae
  misc_feature (B) LOCATION 1...283
  hypothetical: YES
VGSGSSFKKPSKYDILKSEYSSRIRTNNMKQTIILLYGGRSAEREVSVLSAESVMRAVNYDRFTVKTFFISQSGDFIKTQEFSHAPGQEDRLMTNETIDWDKKVAPSAIYEEGAVVFPVLHGPMGEDGSVQGFLEVLKMPYVGCNILSSSLAMDKITTKRVLESAGIAQVPYVAIVEGDDVTAKIAEVEEKLAYPVFTKPSNMGSSVGISKSENQEELRQALKLAFRYDSRVLVEQGVNAREIEVGLLGNYDVKSTLPGEVVKDVAFYDYDAKYIDNKITMDI

SEQ ID NO: 4439 - protein, 172 aa, Streptococcus pneumoniae
  misc_feature (B) LOCATION 1...172
  hypothetical: YES
SVSGLLGADRLIAKCRRLASKKTGEDIVLRAVHNATIKVVQADARRLAPARDGELITSIKTRAKMDGDKAIGEVYTNLKYAPYVEFGTGPIGQASHSGISPEVSVTYKSSPWYVHEDQINVGPYHFQKIGEFYKMYGQPAQPYLYPALRDNQERVSKNISNYVRRKIREQIK

SEQ ID NO: 4440 - protein, 216 aa, Streptococcus pneumoniae
  misc_feature (B) LOCATION 1...216
  hypothetical: YES
EKPGKIVKNWLKTIADVTSKIVEWIINLAPFGILGLVFKTISDKGVGSLANYGILLVPLVTTMLFVAPVVNPLIAFFFMRRNPYPLVWNCLRVSGVTAFFTRSSATNIPVNMKLCHDLGLNPDTYSVSIPLGSTINMAGVAITINLLTLAAVNTLGIPVDFATAFVLSVVAAISACGASGIAGGSLLLIPVACSLFGISNDIAIQVVGVGFVIGVI

SEQ ID NO: 4441 - protein, 244 aa, Streptococcus pneumoniae
  misc_feature (B) LOCATION 1...244
  hypothetical: YES
TITGGDSVLKTERKQLILEELNQHHVVSLEKLVSLLETSESTVRRDLDELEAENKLRRVHGGAELPHSLQEEETIQEKSVKNLQEKKLLAQKAASLIKEKDVIFIDAGTTTAFLIHELVNKNVTVVTNSIHHAAQLVEKQIPTVMVGGNVKTATDASIGGVALNQINQLHFDRAFIGMNGVDDGYYTTPDMEEGAVKKAILENAKQTYVLVDSSKIGQTCFAKVAPLKRAIVITSQXHELLAGY

SEQ ID NO: 4442 - protein, 95 aa, Streptococcus pneumoniae
  misc_feature (B) LOCATION 1...95
  hypothetical: YES
KKTGITVIEPDMLNEKESKQLHYPGLKAGLFFGLWMFFITPLLSILIDEGQDYFHSLLTIRNGVSSILGSIFFGASIQFLISRRIAKTKKNQDED

SEQ ID NO: 4443 - protein, 70 aa, Streptococcus pneumoniae
  misc_feature (B) LOCATION 1...70
  hypothetical: YES
TPAGVRATRFSLFLISFGIPINIEITYLSIDGLVLVVTFQFINQKCDGFIVYETASKIKKNLSSKFFMLD

SEQ ID NO: 4444 - protein, 90 aa, Streptococcus pneumoniae
  misc_feature (B) LOCATION 1...90
  hypothetical: YES
PLAGILLCTERTTTPDVTLLGILSLLMSLVLTLDKLTIWIPKAGRVTFPFFSNCSIILIASFAGIAKPRPSTDVPPFVAILLEVIPITCP

SEQ ID NO: 4445 - protein, 314 aa, Streptococcus pneumoniae
  misc_feature (B) LOCATION 1...314
  hypothetical: YES
FWAGLAMTITMGGLAFVPNIYWLIFLRLLNGVFAGFVPNATALIASQVPKEKSGSALGTLSTGVVAGTLTGPFIGGFIAELFGIRTVFLLVGSFLFLAAILTICFIKEDFQPVAKEKAIPTKELFTSVKYPYLLLNLFLTSFVIQFSAQSIGPILALYVRDLGQTENLLFVSGLIVSSMGFSSMMSAGVMGKLGDKVGNHRLLVVAQFYSVIIYLLCANASSPLQLGLYRFLFGLGTGALIPGVNALLSKMTPKAGISRVFAFNQVFFYLGGVVGPMAGSAVAGQFGYHAVFYATSLCVAFSCLFNLIQLSNTY

SEQ ID NO: 4446 - protein, 93 aa, Streptococcus pneumoniae
  misc_feature (B) LOCATION 1...93
  hypothetical: YES
SWAGSWNISNSVAHVIFRGAFNEYANYIPNYYYENLLQAIERYETMGLEILLSSLTRTMMTQASNIWSRFELFARPCRIVIGMRKLKRRFEDL

SEQ ID NO: 4447 - protein, 143 aa, Streptococcus pneumoniae
  misc_feature (B) LOCATION 1...143
  hypothetical: YES
GVXGKTKDGFPLREVKGISSLIIRKGMEGTEFIWRFGIVLSRGMVQNNRVFWMDKRHNSAFSGRDLEIGLRERRVFTLILTGVWTDICVLHTAKEAYNVGDDIEIVKPAVASIWPENHQFALGHFKNTLGGKSVEENLNELSE

SEQ ID NO: 4448 - protein, 341 aa, Streptococcus pneumoniae
  misc_feature (B) LOCATION 1...341
  hypothetical: YES
PNQGGFMATLKDIAQLASVSIATVSRVLNRDQSLSVTEETRHRILTVAEELGYTKHLKTGESHKPKQKIAIIQWVSEQGELDDLYYYQIRLGIEKRAQELDYDILRYFNDHPFTLSEEVIGILCIGKFSRAQISAFEEYQKPLVFLDSDTLSLGHTCIITDFYTAMKQVVDYFLSQGMDRIGILTGLEETTDQEEIIEDKRLENFRNYSQAKGIYHDELVFQGRFTAQSGYDLMKEAIQSLGDQLPPAFFAASDSLAIGALRALQEAGISLPDRVSLISFNDTSLTKQVYPPLSSITVYTEEMGRAGMDILNKEVLHGRKIPSLTMLGTRLTLRESTLNQE

SEQ ID NO: 4449 - protein, 298 aa, Streptococcus pneumoniae
  misc_feature (B) LOCATION 1...298
  hypothetical: YES
KLQGRGWRQKMKQTRNFDEWLSTMTDTVADWTYYTDFPKVYKNVSSIKVALNIMNSLIGSKNIQEDFLDLYQNYPEILKVVPLLIAKRLRDTIIVKDPIKDFYFDFSKRNYSIEEYTMFLEKSGIFDLLQNHLVSNLVDYVTGVEVGMDTNGRKNRTGDAMENIVQSYLEAEGYILGENLFKEIEQNEIEEIFSVDLSAITNDGNTVKRFDFVIKNEQVLYLIEVNFYSGSGSKLNETARSYKMIAEETKAIPNVEFMWITDGQGWYKAKNNLRETFDILPFLYNINDLEHNILKNLK

SEQ ID NO: 4450 - protein, 313 aa, Streptococcus pneumoniae
  misc_feature (B) LOCATION 1...313
  hypothetical: YES
KVKGVAMSENQQALNHVVSMEDLTVDQVMKLIKRGIEFKNGAQLPYEDHPIVSNLFFEDSTRTHKSFEVAEIKLGLERLDFDVKTSSVNKGETLYDTILTLSALGVDVCVIRHPEVDYYRELIDSPTITTSIINGGDGSGQHPSQSLLDLMTIYEEFGHFEGLKVAIAGDLDHSRVAKSNMQILKRLGAELFFAGPEEWRSQEFADYGKFVTIDEIIDQVDVMMFLRVQHERHDSGAVFSKEDYHAQHGLTQERYDRLKETAILMHPAPINRDVEIADHLVEAPKSRIVQQMTNGVFVRMAILESVLASRNAN

SEQ ID NO: 4451 - protein, 67 aa, Streptococcus pneumoniae
  misc_feature (B) LOCATION 1...67
  hypothetical: YES
IPKGEIKMAVPARRTSKAKKNKRRTHYKVTAPSVNFDETTGDYSRSHRVSLKGYYKGRKITKAASAE

SEQ ID NO: 4452 - protein, 426 aa, Streptococcus pneumoniae
  misc_feature (B) LOCATION 1...426
  hypothetical: YES
IYKGGFPMKWYKKIGLLATTGLALVGLGACSNYGKSADGTVTIEYFNQKKEMTKTLEEITRDFEKENPKIKVKVVNVPNAGEVLKTRVLAGDVPDVVNIYPQSIELQEWAKAGVFEDLSNKDYLKRVKNGYAEKYAVNEKVYNVPFTANAYGIYYNKDKFEELGLKVPETWDEFEQLVKDIVAKGQTPFGIAGADAWTLNGYNQLAFATATGGGKEANQYLRYSQPNAIKLSDPIMKDDIKVMDILRINGSKQKNWEGAGYTDVIGAFARGDVLMTPNGSWAITAINEQKPNFKIGTFMIPGKEKGQSLTVGAGDLAWSISATTKHPKEANAFVEYMTRPEVMQKYYDVDGSPTAIEGVKQAGEDSPLAGMTEYAFTDRHLVWLQQYWTSEADFHTLTMNYVLTGDKQGMVNDLNAFFNPMKADVD

SEQ ID NO: 4453 - protein, 221 aa, Streptococcus pneumoniae
  misc_feature (B) LOCATION 1...221
  hypothetical: YES
LCKGRLCRYFGGHQVMKLYFVRHGRTLWNQEGRFQGASGDSPLLPESIETLKRLGQYLKEIPFDQIYSSDLPRAVKSAEIIQSQLYTPCSLEIVPNLREWQLGKLEGLKIATLEAIYPQQIQAFRSNLAQFDTRMFGAESLYSTTQRTIQFIKSLKDSPAERILIVGHGANLTASLRTLLGYKEPLLRKDGGLANASLTIIETHDFETFTLNTWNDTSYQS

SEQ ID NO: 4454 - protein, 85 aa, Streptococcus pneumoniae
  misc_feature (B) LOCATION 1...85
  hypothetical: YES
YFKGGNQMVVKTRKQGNSITITIPSEFNIPSGVKYEAKLLQSGEIIFTPEELGQQVSYVSDDAFDLNLDKIFDEYDDVFKALVEK

SEQ ID NO: 4455 - protein, 248 aa, Streptococcus pneumoniae
  misc_feature (B) LOCATION 1...248
  hypothetical: YES
DQKGHIYKGVTKIMNKRVKIVATLGPAVEIRGGKKFGEDGYWGEKLDVEASAKNIAKLIEAGANTFRFNFSHGDHQEQGERMATVKLAEKIAGKKVGFLLDTKGPEIRTELFEGEAKEYSYKTGEKIRVATKQGIKSTREVIALNVAGALDIYDDVEVGRQVLVDDGKLGLRVVAKDDATREFEVEVENDGIIAKQKGVNIPNTKIPFPALAERDNDDIRFGLEQGINFIAISFVRTAKECERSSCNL

SEQ ID NO: 4456 - protein, 453 aa, Streptococcus pneumoniae
  misc_feature (B) LOCATION 1...453
  hypothetical: YES
KRKGKIMTKRVTIIDVKDYVGQEVTIGAWVANKSGKGKIAFLQLRDGTAFFQGVAFKPNFVEKFGEEVGLEKFDVIKRLSQETSVYVTGIVKEDERSKFGYELDITDIEVIGESQDYPITPKEHGTDFLMDNRHLWLRSRKQVAVLQIRNAIIYATYEFFDKNGFMKFDSPILSGNAAEDSTELFETDYFGTPAYLSQSGQLYLEAGAMALGRVFDFGPVFRAEKSKTRRHLTEFWMMDAEYSYLTHDESLDLQEAYVKALLQGVLDRAPQALETLERDTELLKRYIAEPFKRITYDQAIDLLQEHENDEDADYEHLEHGDDFGSPHETWISNHFGVPTFVMNYPAAIKAFYMKPVPGNPERVLCADLLAPEGYGEIIGGSMREEDYDALVAKMDELGMDRTEYEFYLDLRKYGTVPHGGFGIGIERMVTFAAGTKHIREAIPFPRMLHRIKP

SEQ ID NO: 4457 - protein, 86 aa, Streptococcus pneumoniae
  misc_feature (B) LOCATION 1...86
  hypothetical: YES
NQKGGNIMTEIHACLCGNWVNLSADDDCVMGPNMASPYIWWEENAELYSPISKPEANSMYHQDYIYIHYRGADYRIHPMFIQIVSR

SEQ ID NO: 4458 - protein, 118 aa, Streptococcus pneumoniae
  misc_feature (B) LOCATION 1...118
  hypothetical: YES
VKKGKNEMHIEHLSHWSGHLNREMYLNRYGHGGIPVVVFASSGGSHNEYYDFGMIDACASFIEEGRVQFFTLSSVDSESWLATWKNAHDQAEMHRAYERYVIEEAILLSSTRQVGLMA

SEQ ID NO: 4459 - protein, 207 aa, Streptococcus pneumoniae
  misc_feature (B) LOCATION 1...207
  hypothetical: YES
KEKGNLMLKLIAIVGTNSKRSTNRQLLQYMQKHFADKAEIELVEIKAIPVFNKPADKQVPAEILEIAAKIEEADGVIIGTPEYDHSIPAVLMSALAWLSYGIYPLLNKPIMITGASYGTLGSSRAQLQLRQILNAPEIKANVLPDEFLLSHSLQAFNPSGDLVDLDVIKKLDAIFDDFRIFVKITEKLRNAQELLRKDAEDFDWENL

SEQ ID NO: 4460 - protein, 156 aa, Streptococcus pneumoniae
  misc_feature (B) LOCATION 1...156
  hypothetical: YES
CFEGWYTNLKDNNYIQRRQHMPNVKEITRESWILATFPEWGTWLNEEIEEEVVPEGNFAMWWLGNCGTWIKTPAGANVVMDLWSNRGKSTKKVKDMVRGHQMANMAGVRKLQPNLRVQPMVIDPFAINELDYYLVSHFHSDHIDPYTAAAFSHFLS

SEQ ID NO: 4461 - protein, 108 aa, Streptococcus pneumoniae
  misc_feature (B) LOCATION 1...108
  hypothetical: YES
IVEGKELCYNGTILRKEGVRMGFTEETVRFKLDDSNKKEISETLTDVYASLNDKGYNPINQIVGYVLSGDPAYVPRYNNARNQIRKYERDEIVEELVRYYLKGQGVDL

SEQ ID NO: 4462 - protein, 171 aa, Streptococcus pneumoniae
  misc_feature (B) LOCATION 1...171
  hypothetical: YES
PPEGSRSGKSLMMKKTYNHILVWGVIFYSICIVYFCFTPQEQSTVGVGTPDIQHLGRLVFLLTPFNSLWKLGEVSDIGQLCWIFLQNILNVFLFFPLIFQLLYLFPNLRKTKKVLLFSFLVSLGIECTQLILDFFFDFNRVFEIDDLWTNTLGGYLAWLLYKRLHKNKIRN

SEQ ID NO: 4463 - protein, 161 aa, Streptococcus pneumoniae
  misc_feature (B) LOCATION 1...161
  hypothetical: YES
NQEGIENYAYTTNSKGEKIYAFEVDGLGNASIMDDPNVPSLLAAPYLGYCSIDDEVYQATRRTILSSENSYFYQGEYASGLGSSHTFYRYIWPIALSIQGLTTRDKAEKKFLLDQLVACDGGTGVMHESFHVDDPTLYSREWFSWANMMFCELVLDYLDIR

SEQ ID NO: 4464 - protein, 360 aa, Streptococcus pneumoniae
  misc_feature (B) LOCATION 1...360
  hypothetical: YES
KKEGTEMTTLFSKIKEVTELAAVSGHEAPVRAYLREKLTPHVDEVVTDGLGGIFGIKHSEAVDAPRVLVASHMDEVGFMVSEIKPDGTFRVVEIGGWNPMVVSSQRFKLLTRDGHEIPVISGSVPPHLTRGKGGPTMPAIADIVFDGGFADKAEAESFGIRPGDTIVPDSSAILTANEKNIISKAWDNRYGVLMVSELAEALSGSKLGNELYLGSNFQEEVGLRGAHTSTTKFDPEVFLAVACSPAGDVYGGQGKIGDGTLIRFYDPGHLLLPGMKDFLLTTAEEAGIKYQYYCGKGGTDAGAAHLKNGGVPSTTIGVCARYIHSHQTLYAMDDFLEAQAFLQALVKKLDRSTVDLIKHY

SEQ ID NO: 4465 - protein, 93 aa, Streptococcus pneumoniae
  misc_feature (B) LOCATION 1...93
  hypothetical: YES
TREGEISMERNNRKVLVGRVVSDKMDKTITVVVETKRNHPVYGKRINYSKKYKAHDENNVAKEGDIVRIMETRPLSATKRFRLVEVVEEAVII

SEQ ID NO: 4466 - protein, 451 aa, Streptococcus pneumoniae
  misc_feature (B) LOCATION 1...451
  hypothetical: YES
NLRGTINYGGIEMLRLVYYQFLHNKKQWLGVSPVIFVSSLVMGLAVNGVINVENNSQVFVGLPDPKPIFMFPIVFGGVTLFFVLSNIINMLVEIFRDDYELLEVLGASRLQLSFLVGGQIFIISSIISFIAYLCSIFVTSNYYYFLQYFFGENILPDIQFQMSAVGCIITVVLISFLAFLSGCFYTFKKIRNRKSSKIRHVLSIVKRILLLAGFSVIWLLSLQQIFQDSTILAKAQIIFNIVILDIVIIYQLSPFIQSCFIKLLSIIIFRNNFMFIVSKWNLLYRKPYIKSISAAITGAILLISSFQMISQNILSQFQDDSDLELKVAFIVYVGAPILIVLANIISIAFLSSHQERIEIQQFEILGTSNYQMVKIKVGEAIFLTFVTSLIAFLLNIKIMVLIYYSLEDILIDDMNLLGLILPNFIVSIILFILIFITKSSYFIFKNAKIIS

SEQ ID NO: 4467 - protein, 125 aa, Streptococcus pneumoniae
  misc_feature (B) LOCATION 1...125
  hypothetical: YES
ENRGYLSRGGTAMRDDIKINDRALALQDQIIEKLEKVFDTDVELDVYNLGLIYEINLDETGLCKIVMTFTDTACDCAESLPIEIVAGLKQIEGIKDIKVEVTWSPAWKITRISRYGRIALGLPPR

SEQ ID NO: 4468 - protein, 484 aa, Streptococcus pneumoniae
  misc_feature (B) LOCATION 1...484
  hypothetical: YES
SNRGYSFMKILFVAAEGAPFSKTGGLGDVIGALPKSLVKAGHEVAVILPYYDMVEAKFGNQIEDVLHFEVSVGWRRQYCGIKKTVLNGVTFYFIDNQYYFFRGHVYGDFDDGERFAFFQLAAIEAMERIAFIPDLLHVHDYHTAMIPFLLKEKYRWIQAYEDIETVLTIHNLEFQGQFSEGMLGDLFGVGFERYADGTLRWNNCLNWMKAGILYANRVSTVSPSYAHEIMTSQFGCNLDQILKMESGKVSGIVNGIDADLYNPQTDALLDYHFNQEDLSGKAKNKAKLQERVGLPVRADVPLVGIVSRLTRQKGFDVVVESLHHILQEDVQIVLLGTGDPAFEGAFSWFAQIYPDKLSANITFDVKLAQEIYAACDLFLMPSRFEPCGLSQMMAMRYGTLPLVHEVGGLRDTVCAFNPIEGSGTGFSFDNLSPYWLNWTFQTALDLYRNHPDIWRNLQKQAMESDFSWDTACKSYLDLYHSLVN

SEQ ID NO: 4469 - protein, 529 aa, Streptococcus pneumoniae
  misc_feature (B) LOCATION 1...529
  hypothetical: YES
RIRGRKMAFESLTERLQNVFKNLRKKGKISESDVQEATKEIRLALLEADVALPVVKDFIKKVRERAVGHEVIDTLNPAQQIIKIVDEELTAVLGSDTAEIIKSPKIPTIIMMVGLQGAGKTTFAGKLANKLKKEENARPLMIAADIYRPAAIDQLKTLGQQIDVPVFALGTEVPAVEIVRQGLEQAQTNHNDYVLIDTAGRLQIDELLMNELRDVKTLAQPNEILLVVDAMIGQEAANVAREFNAQLEVTGVILTKIDGDTRGGAALSVRHITGKPIKFTGTGEKITDIETFHPDRMSSRILGMGDMLTLIEKASQEYDEQKALEMAEKMRENTFDFNDFIDQLDQVQNMGPMEDLLKMIPGMANNPALQNMKVDERQIARKRAIVSSMTPEERENPDLLNPSRRRRIAAGSGNTFVEVNKFIKDFNQAKQLMQGVMSGDMNKMMKQMGINPNNLPKNMPNMGGMDMSALEGMMGQGGMPDLSALGGAGMPDMSQMFGGGLKGKIGEFAMKQSMKRMANKMKKAKKKRK

SEQ ID NO: 4470 - protein, 472 aa, Streptococcus pneumoniae
  misc_feature (B) LOCATION 1...472
  hypothetical: YES
IERGSEMDAKLRYKAKKIKIVFFDIDDTLRNSKTGFIPTTIPTVFKQLREKGILTGIASGRGIFGVVPEIRDLKPDFFVTLNGAYIEDKKGQVIYQHQIEKSYVEEYISWAKQEGIEYGLVGSHDAKLSTRTDMMSEAINPIYPDLDVDPDFHEKEDIYQMWTFEDKGDDLHLPDSLSDKLRMVRWHQHSSDIVPISGSKATGVEKVVEHLGLKPEKVMVFGDGLNDLELFDYAGISVAMGISHDKIKEKADYITQTLEEDVIFDALEVFGMVEKELHFPQVDIETVEGPLATIKTNHGDLRIKLFPEHAPKTVANFVSLSKDGYYDGVIFHRIIKDFMIQGGDPTGTGMGGESIYGESFEDEFSEELYNIRGALSMANAGPNTNGSQFFIVQNQHLPYSKKEITRGGWPEPIAEIYANQGGTPHLDRRHTVFGQLADEASYAVLDVIAAVETGAMDKPVEDVVIETIEIED

SEQ ID NO: 4471 - protein, 222 aa, Streptococcus pneumoniae
  misc_feature (B) LOCATION 1...222
  hypothetical: YES
SKRGENMEAIIEKIKEYKIIVICTGLGLLVGGFFLLKPAPQTPVKETNLQAEVAAVSKDLVSEKEVNKEEKEEPLEQDLITVDVKGAVKSPGIYDLPVGSRVNDAVQKAGGLTEQADSKSLNLAQKVSDEALVYVPTKGEEAVSQQTGLGTASSISKEKKVNLNKASLEELKQVKGLGGKRAQDIIDHREANGKFKSVDELKKVSGIGGKTIEKLKDYVTVD

SEQ ID NO: 4472 - protein, 558 aa, Streptococcus pneumoniae
  misc_feature (B) LOCATION 1...558
  hypothetical: YES
DFGGKMSNISLTTLGGVRENGKNMYIAEIGESIFVLNVGLKYPENEQLGVDVVIPNMDYLFENSDRIAGVFLTHGHADAIGALPYLLAEAKVPVFGSELTIELAKLFVKGNDAVKKFNDFHVIDENTEIDFGGTVVSFFPTTYSVPESLGIVLKTSEGSIVYTGDFKFDQTASESYATDFARLAEIGRDGVLALLSDSANADSNIQVASESEVRDEITQTIADWEGRIIVAAVSSNLSRIQQIFDAADKTGRRIVLTGFDIENIVRTAIRLKKLSLANEILLIKPKDMSRFEDHELIILETGRMGEPINGLRKMSIGRHRYVEIKDGDLVYIATAPSIAKEAFVARVENMIYQAGGVVKLITQSLHVSGHGNVRDLQLMINLLQPKYLFPVQGEYRELDAHAKAAMAVGMLPERIFIPKKGTTMAYENGDFVPAGSVSAGDILIDGNAIGDVGNVVLRDRKVLSEDGIFIVAITVNRREKKIVARARVHTRGFVYLKKSRDILRESSELINQTVEDYLQGDDFDWADLKGKVRDNLTKYLFDQTKRRPAILPVVMEAK

SEQ ID NO: 4473 - protein, 64 aa, Streptococcus pneumoniae
  misc_feature (B) LOCATION 1...64
  hypothetical: YES
VIGGKNMDKDYILKVIGLYHQFLLGNNKTLQVLKNVSLSASRGEFISILGITWFWKVNFIKMYF

SEQ ID NO: 4474 - protein, 105 aa, Streptococcus pneumoniae
  misc_feature (B) LOCATION 1...105
  hypothetical: YES
KIGGNIMKLINTTNSHSQLVKSQLESTDATLVEVYSAGNTDVIFTQAPLHYEILISNKHRAIREPEIETIQEFFLKRKIDKASVDEANIKTLYSEKLIGISIPIK

SEQ ID NO: 4475 - protein, 436 aa, Streptococcus pneumoniae
  misc_feature (B) LOCATION 1...436
  hypothetical: YES
KNGGFVMNKKSLLKCAVIGLVATFGLAACGTSKDASGGSSSGKEVLEFYHGYHHSEDEWPVAKTMRDLYDKFAEEHKDSGVEFKPTPVNGDLKDIMNNKVASGEFPDVIDLAGNAVSLAAIEQKLVLDLKPYIDSNKLEKNVGLNYKQNQKDGKIYTVHEQLFTMGLWYNKDIFAKAGAKTPDQWNTWDDFTQAMASIRKQDGVYAFGAGEPSIRLFNTVLGTTENGRKLLDKPLTKEGIESKEFADALKMVMKEIQANGSKNAGGDANAYSKDFQEGKSAVFFNGVWASGEMSKNPSLAPGIYPAGVAISSSGGGITISSKMSEAKQKLALEFLKYMTSDDVQKVIFEKVGANPSNENVNVKELSEKSSEATTKILGQAITQVKNAKAVVPTVSDVWGGDVHTAIINALTESAAENVDVDQKVKSTQDVLKSLIG

SEQ ID NO: 4476 - protein, 198 aa, Streptococcus pneumoniae
  misc_feature (B) LOCATION 1...198
  hypothetical: YES
TLGGLMKLLEDRILKDGHILGDNILKVDSFLTHQVDFSLMREIGKVFAEKFAAAGITKVVTIEASGIAPAVFTAEALNVPMIFAKKAKNITMNEGILTAQVYSFTKQVTSTVSIAGKFLSPEDKVLIIDDFLANGQAAKGLIQIIEQAGATVQAIGIVIEKSFQDGRDLLEKAGYPVLSLARLDRFENGQVVFKEADL

SEQ ID NO: 4477 - protein, 143 aa, Streptococcus pneumoniae
  misc_feature (B) LOCATION 1...143
  hypothetical: YES
RIGGCMQIEFFNFLRSVVQTEDGLVLYALALIVSMEIIDFVTGTIAAIINPDIEYKSKIGINGLLRKISGVLLLMILIPASVLLPEKTGFVFLHSIYLGYIAFTFQSLIENYRKLKGNVTLFQPIVKVFQRLLEKDDDTKKGE

SEQ ID NO: 4478 - protein, 499 aa, Streptococcus pneumoniae
  misc_feature (B) LOCATION 1...499
  hypothetical: YES
SKGGSIVILVDKFVTHVISESSFEEMDRIYLTNRVLARVGEGVLEVETNLDKLIDLKDQLVEEAVRLEMIEDSQTAREILGTELMDLVTPYPSQVNRDFWEAYVHSPEQAIEDFYQLSQKNDYIKLKAIAKNIAYRVPSDYGELEITINLSKPEKDPKEIAVAKLVQASNYPQCQLCLENEGYHGRVNHPARSNHRIIRFEMVGQEWGFQYSPYAYFNEHCIFLDGQHRPMAISRQSFERLLAIVEQFPGYFAGSNADLPIVGGSILTHDHYQGGRHVFPMELAPLQKTFRFAGFEQVKAGIIKWPMSVLRLTSDSKEDLINLADKIFQEWRQYSDSSVQILAETDGTPHHTITPIARKRDGQFELDLVLRDNQTSAEHPDGIYHPHKDVQHIKKENIGLIEVMGLAILPPRLKEEVEQVASYLVGEAVTVADYHQEWADQLKSQHPDLTDKEKALAIVKDSVGAIFVRVLEDAGVYKQTEQGQTAFMRFVEQVGISLD

SEQ ID NO: 4479 - protein, 238 aa, Streptococcus pneumoniae
  misc_feature (B) LOCATION 1...238
  hypothetical: YES
EKGGKRMSQISKEALIEQIKDGIIVSCQALPHEPLYTEAGGVIPLLVKAAEQGGAVGIRANSVRDIKEIKEVTKLPIIGIIKRDYPPQEPFITATMKEVDELAELDIEVIALDCTKRERYDGLEIQEFIRQVKEKYPNQLLMADTSIFEEGLAAVEAGIDFVGTTLSGYTSYSPKVDGPDFELIKKLCDAGVDVIAEGKIHTPEQAKQILEYGVRGIVVGGAITRPKEITERFVAGLK

SEQ ID NO: 4480 - protein, 201 aa, Streptococcus pneumoniae
  misc_feature (B) LOCATION 1...201
  hypothetical: YES
EKGGLDMLQLTHVTLKTRQVILQDADFTFKKGRFYGLLAINGSGKTTLFRAISNLIPISSGNIAAPPSLFYYESIEWLDGNLSGMDYLRLIKNIWKSDLNLRDEIAYWEMADYISLPIRKYSLGMKQRLVIAMYFLSQAKCWLMDEITNGLDEYYRQKFFDRLAQIDRQEQLVLLSSHYKEELVDICDRVVTIHQGQIEEV

SEQ ID NO: 4481 - protein, 77 aa, Streptococcus pneumoniae
  misc_feature (B) LOCATION 1...77
  hypothetical: YES
QKGGRNVQWTLEAMRINKGLTQAELAEKFEVSSQTIARLEKDSSDIGYQLLKKYMFFFNVKFDDIFLGKKYENFVNN

SEQ ID NO: 4482 - protein, 93 aa, Streptococcus pneumoniae
  misc_feature (B) LOCATION 1...93
  hypothetical: YES
IEGGGHKLKRFIAIWILLSAGLNIWQSIYIKKLEEKRPIVVYKADNAGAEIFGKVVEKGRHGKLYTLTIRDYGVFVVTKDVYEKVKVGDEVLL

SEQ ID NO: 4483 - protein, 212 aa, Streptococcus pneumoniae
  misc_feature (B) LOCATION 1...212
  hypothetical: YES
RRGGLRAEQTAKADGTVGSKSQGAAQKKAEVVNKGDYYSIQGKYDEIIVANKHYPLSKDYNPGENPTAKAELVKLIKAMQEAGFPISDHYSGFRSYETQTKLYQDYVNQDGKAAADRYSARPGYSEHQTGLAFDVIGTDGDLVTEEKAAQWLLDHAADYGFVVRYLKGKEKETGYMAEEWHLRYVGKEAKEIAESGLSLEEYYGFEGGDYVD

SEQ ID NO: 4484 - protein, 804 aa, Streptococcus pneumoniae
  misc_feature (B) LOCATION 1...804
  hypothetical: YES
QGGGEKMALAKIIVDVPLMQTDQPYSYRIPEEFEGMLEVGMRVHVPFGKGNRLIQGIVLGLKSQSDGEEMEQDLKDIAEVLDFSPVLTPEQLWLAEELRKSVFSYKISILKAMLPGFLNSSYDKILYPLEGLSQEERVRLFGSEDSLAFSSLDLAKQAEMMRLTRKGLLGLEYQAVDQKKVKTQSWYEVDHAQLEGVEISTRAKKKLELRDYLLSHPESASLASLLESYSREQVNFFVDQGAVTIVQKEVQRSAAYFEGIEASRPLELNPEQRQARDAVVSSIGSSQPPFLLQGITGSGKTEVYLQIIQGALDKGKTAILLVPEISLTPQMTERFIARFGDKVAILHSGLSNGEKYDEWRKVERGDAQVVVGARSAIFAPLKNLGVMIIDEEHEAAYKQDSNPRYHAREVAILRAQYNQATLVLGSATPSLESRARAGKGVYQHLRLTQRANPLATIPEVQVIDFRDYIGQNETSNFTPPLLEAIQDRLVKKEQVVLMLNRRGYSSFVMCRECGTVDTCPNCDISLTLHMDTKTMNCHYCGFSKDIPQVCPNCKSHSIRYYGTGTQKAYDELAELFPQARILRMDVDTTRKKGSHQALLDQFGRGEADILLGTQMIAKGLDFPNVTLVGVLNADTALNLPDFRSSERTFQLLTQVAGRSGRAEKAGQVLIQSYNPQHYAIRFAKDQDYEGFYAYEMGIRRQLGYPPYYFTIGITLSHKKEEEVFKRAYEVMNILRSGLSETSPILGPTPKPIARTHNLYHYQILIKYRLEDELGPTLNQVLALTQERENSELRLSIDHEPQQFL

SEQ ID NO: 4485 - protein, 66 aa, Streptococcus pneumoniae
  misc_feature (B) LOCATION 1...66
  hypothetical: YES
VKGGYIIKVDGKYYVYLKDQAHAENVRTKDEINRQKQEHGKDDKGASAEVSVAKLQGRYTTDDGYI

SEQ ID NO: 4486 - protein, 391 aa, Streptococcus pneumoniae
  misc_feature (B) LOCATION 1...391
  hypothetical: YES
RCLGRQVTNDKASGRCWMFAALNTFRHKLISQYKLENFELSQAHTFFWDKYEKSNWFLEQVIATSDQELTSRKVSFLLQTPQQDGGQWDMVVSLFEKYGVVPKSVYPESVSSSSSRELNAILNKLLRQDAQILRDLLVSGADQATVQAKKEDLLQEIFNFLAMSLGLPPRKFDFAYRDKDNNYKSEKGITPQEFYKKYVNLPLEDYVSVINAPTADKPYGKSYTVEMLGNVVGSRAVRYINVPMERLKELAIAQMQAGETVWFGSDVGQLSNRKAGILATDVYDFESSMDIKLTQDKAGRLDYSESLMTHAMVLTGVDLDENGKSTKWKVENSWGDKVGTDGYFVASDAWMDEYTYQIVVRKELLTAEEQAAYGAEPIVLAPWDPMGALAE

SEQ ID NO: 4487 - protein, 60 aa, Streptococcus pneumoniae
  misc_feature (B) LOCATION 1...60
  hypothetical: YES
NSLGSDCFNREIEMSFIAQDFDKLNIITVLESRTQAIIRNPMNTRLSSDTESSFNKIVRN

SEQ ID NO: 4488 - protein, 579 aa, Streptococcus pneumoniae
  misc_feature (B) LOCATION 1...579
  hypothetical: YES
NILGVGEIKEIIEKEGVGGNFRMQTDVAARNRVIELKPIGDVVEKLGISYDDLELYGKYKAKLSFDKIRAVESNPVGKLILVTAINPTPAGEGKSTLTIGLADALNKIGKKTMIAIREPSLGPVMGIKGGAAGGGYAQVLPMEDINLHFTGDMHAITTANNALSALIDNHLHQGNELGIDQRRILWKRVVDLNDRALRHVTVGLGGPLNGIPREDGFDITVASEIMAILCLATDIEDLKRRLANIVIGYRYDRTPVSVGDLQVEGALALILMDAIKPNLVQTIYGTPAFVHGGPFANIAHGCNSVLATTTALHLADYTVTEAGFGADLGAEKFLDIKTPNLPTSPDAVVIVATLRALKMNGGVAKDALTEENVEAVRAGFANLKRHVENIRKFGIPAVVAINEFVSDTEAEIAVLKELCASIDVPVELASVWADGAEGGVALAETVVKTIAENPANYKRLYDNDLSVQEKIEKIVTEIYRGSKVNFEKKSQTQIAQIVQNGWDKLPICMAKTQYSFSDNPNALGAPENFEITIRELVPKLGAGFIVALTGDVMTMPGLPKRPAALNMDVESDGTVLGLF

SEQ ID NO: 4489 - protein, 121 aa, Streptococcus pneumoniae
  misc_feature (B) LOCATION 1...121
  hypothetical: YES
YNMGMILMKLASILLLILTLVVCIILTKLFRLKKLGRNFADLAFPVLVFEYYLITAKTFTHNFLPRLGLALSFLAIILVFFFLLKKRSFYYPKFIKFFWRAGFLLTLIMYIEMIVELFLMK

SEQ ID NO: 4490 - protein, 62 aa, Streptococcus pneumoniae
  misc_feature (B) LOCATION 1...62
  hypothetical: YES
LDMGIKMEKIFVIIFFVCLFISSITFLAYDFVSEEIKKLIIWINVVFLILIIAMMIYPKLRK

SEQ ID NO: 4491 - protein, 109 aa, Streptococcus pneumoniae
  misc_feature (B) LOCATION 1...109
  hypothetical: YES
RPMGMKQEEAEKKASGLLEQLGLGGHAEAYPFSLSGGQKQRVALARAMMIDPEIIGYDEPTSALDPELRLEVEKLILQNRELGMTQIVVTHDLQFAENIADVLLKVEPK

SEQ ID NO: 4492 - protein, 141 aa, Streptococcus pneumoniae
  misc_feature (B) LOCATION 1...141
  hypothetical: YES
PKMGRNSNIDLYLDQVLLYVNQVCAPISPNKDKGLTASMVNNYVKNGYLTKPDKKKYQRQQIARLIAITTLKSVFSIQEIAQTLNTLQTQASSDQLYDAFVDYMNQGIDPANPIIQTSCQTVKLYHQTLDLIDHTQEEVIQ

SEQ ID NO: 4493 - protein, 70 aa, Streptococcus pneumoniae
  misc_feature (B) LOCATION 1...70
  hypothetical: YES
YEMGEEEMRNKMIIAVSLVVAGVMTYLMFSGLDEDFYHFPWKVFAGFGIMSWLVREGLKLVRDVKKEFEE

SEQ ID NO: 4494 - protein, 290 aa, Streptococcus pneumoniae
  misc_feature (B) LOCATION 1...290
  hypothetical: YES
VEVGSCLLLVFTEGGLMPELPEVETVCRGLEKLIIGKKISSIEIRYPKMIKTDLEEFQRELPSQIIESMGRRGKYLLFYLTDKVLISHLRMEGKYFYYPDQGPERKHAHVFFHFEDGGTLVYEDVRKFGTMELLVPDLLDAYFISKKLGPEPSEQDFDLQVFQSALAKSKKPIKSHLLDQTLVAGLGNIYVDEVLWRAQVHPARPSQTLTAEEATAIHDQTIAVLGQAVEKGGSTIRTYTNAFGEDGSMQDFHQVYDKTGQECVRCGTIIEKIQLGGRGTHFCPNCQRGD

SEQ ID NO: 4495 - protein, 108 aa, Streptococcus pneumoniae
  misc_feature (B) LOCATION 1...108
  hypothetical: YES
NSPGSDCFNREMEMSFIAQDFNNLNIITVLEGRTQAIIRNHFLRYDRAVRCRVKIITMDMFSPYYGLAKQLRFQISRLRLKQSPRLFHSRMLKSFLIAFTLCNILAVL

SEQ ID NO: 4496 - protein, 108 aa, Streptococcus pneumoniae
  misc_feature (B) LOCATION 1...108
  hypothetical: YES
NSPGSDCFNREMEMSFIAQNFEKLDIITVLEGRTQAVIRDHFLKYDRAVRCRVKIITMDMFSPYYDLAKQLRFQISRLRLKQSPRLFHSRMLKSFLIAFTLYNILAVL

SEQ ID NO: 4497 - protein, 108 aa, Streptococcus pneumoniae
  misc_feature (B) LOCATION 1...108
  hypothetical: YES
NSPGSDCFNREMEMSFIAQDFNNLNIITVLEGRTQAIIRNHFLRYDRAVRCRVKIITMDMFSPYYDLAKQLRFQISRLRLKQSPRLFHSRMLKSFLIAFTLYNILAVL

SEQ ID NO: 4498 - protein, 108 aa, Streptococcus pneumoniae
  misc_feature (B) LOCATION 1...108
  hypothetical: YES
NSPGSDCFNREMEMSFIAQDFDKLNIITVLEGRTQAIIRNHFLRYDRAVRCRVKIITMDMFSPYYGLAKQLRFQISRLRLKQSPRLFHSRMLKSFLIAFTLYNILAVL

SEQ ID NO: 4499 - protein, 266 aa, Streptococcus pneumoniae
  misc_feature (B) LOCATION 1...266
  hypothetical: YES
NSPGSDCFNREMEMSFIAQDFEKLDIITVLEGRTQAVIRDHFLKYDRAVRCRVKIITMDMFSPYYDLARQLFPCAKIVLDRFHIVQHLSRAMSRVHVQIMNQFHRKSHEYKAIKRYWKLIQQDSCKLSDKRFYRPIFRMHLTNKEILNKLLSYSEDLKHHYQLYQLLLFHFQNKEPEKFFGLIEDNLKQVHPIFQTVFKTFLKDKEKIINALQLHYSNAKLEATNNLIKLIKRNAFGFRNFENFKKRIFIALNIKKERTKFVLSRA

SEQ ID NO: 4500 - protein, 108 aa, Streptococcus pneumoniae
  misc_feature (B) LOCATION 1...108
  hypothetical: YES
NSPGSDCFNREMEMSFIAQDFEKLDIITVLEGRTQAVIRDHFLKYDRAVRCRVKIITMDMFSPYYDLAKQLRFQISRLRLKQSPRLFHSRMLKSFLIAFTLCNILAVL

SEQ ID NO: 4501 - protein, 81 aa, Streptococcus pneumoniae
  misc_feature (B) LOCATION 1...81
  hypothetical: YES
EDTGLFPYKLFWRITQVRLKGTVLKTVRRVKACVGSNPTSSFYINAGWSSSVARRAHNPKVVGSNPAPAIRLGSSVGRAMD

SEQ ID NO: 4502 - protein, 68 aa, Streptococcus pneumoniae
  misc_feature (B) LOCATION 1...68
  hypothetical: YES
AGTGCCVKKIKLLVFVEYCVSFFSYIPIFEAELERILRPYDVFEKVSWQFLKKMSVFLQTKGSNQKEY

SEQ ID NO: 4503 - protein, 725 aa, Streptococcus pneumoniae
  misc_feature (B) LOCATION 1...725
  hypothetical: YES
LDKGNFMGLKHLEDVTYFRLNNEINRPVNGQIMLHKDKEALDAFFKENVVPNTMVFDSIKDKINYLIEHNYIETAFIKKYRPEFLEELAQFIKDQNFQFKSFMAAYKFYNQYALKTNDGEYYLENMEDRVFFNALYFADGNEAVAIDIANEIIHQRYQPATPSFLNAGRARRGELVSCFLIQVTDDMNSIGRSINSALQLSRIGGGVGITLSNLREAGAPIKGYEGAASGVVPVMKLFEDSFSYSNQLGQRQGAGVVYLNVFHPDIIAFLSTKKENADEKVRVKTLSLGVVVPDKFYELARKNEEMYLFSPYSVEKEYGVPFNYIDITEKYDELVANPNIRKTKIKARDLETEISKLQQESGYPYVVNIDTANRANPVDGKIIMSNLCSEILQVQEPSLINDAQEFLQMGTDVSCNLGSTNVVNMMTSPDFGRSIRAMVRALTFVTDSSHIVAVPTIDHGNSQAHTFGLGAMGLHSYLAQQLIEYGSPESVEFTSIYFMLMNYWTLVESNNIARERGITFHNFEKSDYANGSYFDKYVTGEFVPTSDRVKELFKNVFIPGVADWAELRDKVQEDGLYHQNRLAVAPNGSISYINDVSASIHPITQRIEERQEKKIGKIYYPAAGLSTETIPYYTSAYDMDMRKVIDVYAAATEHVDQGLSLTLFMRSDIPKGLYEWKRENKQTTRDLSILRNYAFNKGIKSIYYVRTFTDDGGEVGANQCESCVI

SEQ ID NO: 4504 - protein, 816 aa, Streptococcus pneumoniae
  misc_feature (B) LOCATION 1...816
  hypothetical: YES
IEKGSKMNYSKALNECIESAYMVAGHFGARYLESWHLLIAMSNHSYSVAGATLNDYPYEMDRLEEVALELTETDYSQDETFTELPFSRRLQVLFDEAEYVASVVHAKVLGTEHVFYAILHDGNALATRILERAGFSYEDKKDQVKIAALRRNLEERAGWTREDLKALRQRHRTVADKQNSMANMMGMPQTPSGGLEDYTHDLTEQARSGKLEPVIGRDKEISRMIQILSRKTKNNPVLVGDAGVGKTALALGLAQRIASGDVPAEMAKMRVLQLDLMNVVAGTRFRGDFEERMNNIIKDIEEDGQVILFIDELHTIMGSGSGIDSTLDAANILKPALARGTLRTVGATTQEEYQKHIEKDAALSRRFAKVTIEEPSVADSMTILQGLKATYEKHHRVQITDEAVETAVKMAHRYLTSRHLPDSAIDLLDEAAATVQNKAKHVKADDSDLSPADKALMDGKWKQAAQLIAKEEEVPVYKDLVTESDILTTLSRLSGIPVQKLTQTDAKKYLNLEAELHKRVIGQDQAVSSISRAIRRNQSGIRSHKRPIGSFMFLGPTGVGKTELAKALAEVLFDDESALIRFDMSEYMEKFAASRLNGAPPGYVGYEEGGELTEKVRNKPYSVLLFDEVEKAHPDIFNVLLQVLDDGVLTDSKGRKVDFSNTIIIMTSNLGATAFRDDKTVGFGAKDIRFDQENMEKRMFEELKKAYRPEFINRIDEKVVFHSLSSDHMQEVVKIMVKPLVASLAEKGIDLKLQASALKLLANQGYDPEMGARPLRRTLQTEVEDKLAELLLKGDLVAGSTLKIGVKAGQLKFDIA

SEQ ID NO: 4505 - protein, 255 aa, Streptococcus pneumoniae
  misc_feature (B) LOCATION 1...255
  hypothetical: YES
IVEGMVMSNNTKYIFLSPHLDDAIFSCGDYISKLTSEGEIVLVITIFSGYPLSQQLQPSAKQFHKLCNLGKYPIEERKKEDRLACERLQCDFRHLSYYECLYRKDRNGNFLYRHIYSELKNEDTLKNDIIKELLMHLDDKCVVYCPLSLGDHIDHVFVNSIGRALEFMRYKVIYYEDFPYVSDSSMVSYMGKTKELKMYQEELDEKHYIDRISSILCYKSQILIIWKSVEKLLNNIKELYLRNGAAYSIRFWIKK

SEQ ID NO: 4506 - protein, 2238 aa, Streptococcus pneumoniae
  misc_feature (B) LOCATION 1...2238
  hypothetical: YES
YKEGFMGKGHWNRKRVYSIRKFAVGACSVMIGTCAVLLGGNIAGESVVYADETLITHTAEKPKEEKMIVEEKADKALETKNVVERTEQSEPSSTEAIASEKKEDEAVTPKEEKVSAKPEEKAPRIESQASSQEKPLKEDAKAVTNEEVNQMIEDRKVDFNQNWYFKLNANSKEAIKPDADVSTWKKLDLPYDWSIFNDFDHESPAQNEGGQLNGGEAWYRKTFKLDEKDLKKNVRLTFDGVYMDSQVYVNGQLVGHYPNGYNQFSYDITKYLHKDGRENVIAVHAVNKQPSSRWYSGSGIYRDVTLQVTDKVHVEKNGTTILTPKLEEQQHGKVETHVTSKIVNTDDKDHELVAEYQIVERGGHAVTGLVRTASRTLKAHESTSLDAILEVERPKLWTVLNDKPALYELITRVYRDGQLVDAKKDLFGYRYYHWTPNEGFSLNGERIKFHGVSLHHDHGALGAEENYKAEYRRLKQMKEMGVNSIRTTHNPASEQTLQIAAELGLLVQEEAFDTWYGGKKPYDYGRFFEKDATHPEARKGEKWSDFDLRTMVERGKNNPAIFMWSIGNEIGEANGDAHSLATVKRLVKVIKDVDKTRYVTMGADKFRFGNGSGGHEKIADELDAVGFNYSEDNYKALRAKHPKWLIYGSETSSATRTRGSYYRPERELKHSNGPERNYEQSDYGNDRVGWGKTATASWTFDRDNAGYAGQFIWTGTDYIGEPTPWHNQNQTPVKSSYFGIVDTAGIPKHDFYLYQSQWVSVKKKPMVHLLPHWNWENKELASKVADSEGKIPVRAYSNASSVELFLNGKSLGLKTFNKKQTSDGRTYQEGANANELYLEWKVAYQPGTLEAIARDESGKEIARDKITTAGKPAAVRLIKEDHAIAADGKDLTYIYYEIVDSHGNVVPTANNLVRFQLHGQGQLVGVDNGEQASRERYKAQADGSWIRKAFNGKGVAIVKSTEQAGKFTLTAHSDLLKSNQVTVFTGKKEGQEKTVLGTEVPKVQTIIGEAPEMPTTVPFVYSDGSRAERPVTWSSVDVSKPGIVTVKGMADGREVEARVEVIALKSELPVVKRIAPNTDLNSVDKSVSYVLTDGSVEEYEVDKWEIAEEDKAKLAIPGSRIQATGYLEGQPIHATLVVEEGNPAAPAVPTVTVGGEAVTGLTSQKPMQYRTLAYGAKLPEVTASAKNAAVTVLQASAANGMRASIFIQPKDGGPLQTYAIQFLEEAPKIAHLSLQVEKADSLKEDQTVKLSVRAHYQDGTQAVLPADKVTFSTSGEGEVAIRKGMLELHKPGAVTLNAEYEGAKGQVELTIQANTEKKIAQSIRPVNVVTDLHQEPSLPATVTVEYDKGFPKTHKVTWQAIPKEKLDSYQTFEVLGKVEGIDLEARAKVSVEGIVSVEEVSVTTPIAEAPQLPESVRTYDSNGHVSSAKVAWDAIRPEQYAKEGVFTVNGRLEGTQLTTKLHVRVSAQTEQGANISDQWTGSELPLAFASDSNPSDPVSNVNDKLISYNNQPANRWTNWNRSNPEASVGVLFGDSGILSKRSVDNLSVGFHEDHGVGAPKSYVIEYYVGKTVPTAPKNPSFVGNEDHVFNDSANWKPVTNLKAPAQLKAGEMNHFSFDKVETYAVRIRMVRADNKLGTSITEVQIFAKQVAAAKQGQTRIQVDGKDLANFNPDLTDYYLESVDGKVPAVTASVSNNGLATVVPSVREGEPVRVIAKAENGDILGEYRLHFTKDKNLLSHKPVAAVKQARLLQVGQALELPTKVPVYFTGKDGYETKDLSVEWEEVPAENLTKAGQFTVRGHVLGSDLVAEVTVRVTDKLGEALSDNPNYDENSNQAFASATNDIDKNSHDRVDYLNDGDHSENRRWTNWSPTPSSNPEVSAGVIFRENGKIVERTVAQAKLHFFADSGTDAPTKLVLERYVGPEFEVPTYYSNYQAYDADHPFNNPENWEAVPYRADKDIAAGDEINVTFKAVKAKAMRWRMERKADKSGVAMIEMTFLAPSELPQESTQSKILVDGKELADFAENRQDYQITYKGQRPKVSVEENNQVASTVVDSGEDSLPVLVRLVSESGKQVKEYRIHLTKEKPVSEKTVAAVQEDLPKLEFVEKDLAYKTVEKKDSTLYLGETRVEQEGKTGKERIFTAINPDGSKEEKLREVVEAPTDRIVLVGTKPVAQEAKKPQVSEKADTKPIDSSEASQTNKAQLPNTGSAASQAAVAAGLALLGLSAGLVVTKGKKED

SEQ ID NO: 4507 - protein, 413 aa, Streptococcus pneumoniae
  misc_feature (B) LOCATION 1...413
  hypothetical: YES
RGRGNSNRGQDALSACSGSGASTKGEKTFSYIYETDPDNLNYLTTAKAATANITSNVVDGLLENDRYGNFVPSMAEDWSVSKDGLTYTYTIRKDAKWYTSEGEEYAAVKAQDFVTGLKYAADKKSDALYLVQESIKGLDAYVKGEIKDFSQVGIKALDDQTVQYTLNKPESFWNSKTTMGVLAPVNEEFLNSKGDDFAKATDPSSLLYNGPYLLKSIVTKSSVEFAKNPNYWDKDNVHIDKVKLSFWDGQDTSKPAENFKDGSLTAARLYPTSASFAELEKSMKDNIVYTQQDSITYLVGTNIDRQSYKYTSKTSDEQKASTKKALLNKDFRQAIAFGFDRTAYASQLNGQTGASKILRNLFVPPTFVQADGKNFGDMVKEKLVTYGDEWKDVNLADSQDGLYNTEKGKAEIC

SEQ ID NO: 4508 - protein, 91 aa, Streptococcus pneumoniae
  misc_feature (B) LOCATION 1...91
  hypothetical: YES
TIRGPCALKNRRQRTNRWGLCPCRLSQEKTKTAQVVATGQGVRTLNGDLVAPSVKTGDRVLVEAHAGLDVKDGDEKYIIVGEANILAIIEE

SEQ ID NO: 4509 - protein, 450 aa, Streptococcus pneumoniae
  misc_feature (B) LOCATION 1...450
  hypothetical: YES
QNRGENMSKTYHFIGIKGSGMSALALMLHQMGHKVQGSDVEKYYFTQRGLEQAGITILPFDEKNLDGDMEIIAGNAFRPDNNVEIAYADQNGISYKRYHEFLGSFMRDFVSMGVAGAHGKTSTTGMLSHVLSHITDTSFLIGDGTGRGSANAKYFVFESDEYERHFMPYHPEYSIITNIDFDHPDYFTSLEDVFNAFNDYAKQITKGLFVYGEDAELRKITSDAPIYYYGFEAEGNDFVASDLLRSTTGSTFTVHFRGQNLGQFHIPTFGRHNIMNATAVIGLLYTAGFDLNLVREHLKTFAGVKRRFTEKIVNDTVIIDDFAHHPTEIIATLDAARQKYPSKEIVAVFQPHTFTRTIALLDDFAHALNQADAVYLAQIYGSAREVDHGDVKVEDLANKINKKHQVITVENVSPLLDHDNAVYVFMGAGDIQTYEYSFERLLSNLTSNVQ

SEQ ID NO: 4510 - protein, 379 aa, Streptococcus pneumoniae
  misc_feature (B) LOCATION 1...379
  hypothetical: YES
KNRGKIKMTVLKGDNLEILKTIESSSIDLIYMDPPFFTQKTQKLSNNKNIMYSFEDTWTSIEDYKEFLSVRLEECKRVLKNSGSIFVHCDKIANHHIRLILDNIFGADMFQSEIIWNYKRWSNSKKGLLNNHQNIYFYSKSKDFKFNTIFTEYSSTTNIDQILVERKRDGNSKTIYKVDNNGNYILAKEKNGVPLSDVWNIPFLNPKAKERVGYPTQKPILLLEQIIKIATDKNDIVLDPFCGSGTTLVASKILNRNYMGIDLSEEAINITQQRLENVIKTSSNLLNKGIEAYRTKTEEEENILKLLQAKIVQRNKGIDGFLPKHFQKKPIPIIIPKNNECLNESISLLQKAINSKRIELWSIIKNPSDNLLCDFETIP

SEQ ID NO: 4511 - protein, 351 aa, Streptococcus pneumoniae
  misc_feature (B) LOCATION 1...351
  hypothetical: YES
RSRGSRAGRNEIQPSSSPYCRGETNVNFSCRKIKSGIGGNRMMRSTKELRHVYRDFLLEANQSYSDIVVLEADLSSSMATHNLEKDFGDRYVNVGIMEAEMVGLAAGLSIQGFRPYLHTFGPFASRRVFDQLFISLGYAQLDATVIGSDAGVTAEMNGGTHMPFEEIGLLRLIPKSIIFEATDDIQFREILNQTLDLKGLKYIRTIRKAPVPVYQGGEDFSKGYIELRHGEDLVIVASGIMVAPSIRVADELSKLGYSVSVIDLFRIKPIPEQIKTMLSGKTIFTVENHNQIGGIGSALCELFSDDGITKIHRMGVQERFGQVGKMDYLLNEYGLSESNIKEKVLEIYNAR

SEQ ID NO: 4512 - protein, 143 aa, Streptococcus pneumoniae
  misc_feature (B) LOCATION 1...143
  hypothetical: YES
EKRGCSCLIKRGDVVALYLPFPTISSDLAVKNHMYICIDNSMTKNKELVKNQTFKPALLTRRLVKNFMIEEPDLARNPFTRPTLIDLDKVFMLDNTVIPTSYLARRRRNVSEELYEEILDYLVQPRLISLNKSEFMQLNPGTY

SEQ ID NO: 4513 - protein, 82 aa, Streptococcus pneumoniae
  misc_feature (B) LOCATION 1...82
  hypothetical: YES
NGRGGIRTPEPEGADLQSAAFSLFATLPKYINGARRNRTADTWSFNPLLYQLSYRALLREQDLNLRPSGYEPDELPSCSIPR

SEQ ID NO: 4514 - protein, 511 aa, Streptococcus pneumoniae
  misc_feature (B) LOCATION 1...511
  hypothetical: YES
DVRGSFMFKVLQKVGKAFMLPIAILPAAGLLLGIGGALSNPTTIATYPILDNSIFQSIFQVMSSAGEVVFSNLSLLLCVGLCIGLAKRDKGTAALAGVTGYLVMTATIKALVKLFMAEGSAIDTGVIGALVVGIVAVYLHNRYNNIQLPSALGFFGGSRFVPIVTSFSSILIGFVFFVIWPPFQQLLVSTGGYISQAGPIGTFLYGFLMRLSGAVGLHHIIYPMFWYTELGGVETIAGQTVVGAQKIFFAQLADPAHSGLFTEGTRFFAGRFSTMMFGLPAACLAMYHSVPKNRRKKYAGLFFGVALTSFITGITEPIEFMFLFVSPVLYVVHAFLDGVSFFIADVLNISIGNTFSGGVIDFTLFGILQGNAKTNWVLQIPIGLIWSVLYYIIFRWFITQFNVLTPGRGEEVDSKEISESADSTSNTADYLKQDSLQIIRALGGSNNIEDVDACVTRLRVAVKEVNQVDKALLKQIGAVDVLEVKGGIQAIYGAKAILYKNSINEILGVDD

SEQ ID NO: 4515 - protein, 212 aa, Streptococcus pneumoniae
  misc_feature (B) LOCATION 1...212
  hypothetical: YES
YKILNIESFLTMNQSYFYLKMKEHKLKVHYTGKERRVRILLPKDYEKDTDRSYPVVYFHDGQNVFNSKESFIGHSWKIIPAIKRNPDISRMIVVAIDNDGMGRMNEYAAWKFQESPIPGQQFGGKGVEYAEFVMEVVKPFIDETYRTKADCQHTAMIGSSLGGNIPSLSVWNTKTKLVAWAFFHLQTGSTKKPLTAISSARNYRLTSASSSM

SEQ ID NO: 4516 - protein, 313 aa, Streptococcus pneumoniae
  misc_feature (B) LOCATION 1...313
  hypothetical: YES
LFFIKEYSMSKKLTFQEIILTLQQFWNDQGCMLMQAYDNEKGAGTMSPYTFLRAIGPEPWNAAYVEPSRRPADGRYGENPNRLYQHHQFQVVMKPSPSNIQELYLESLEKLGINPLEHDIRFVEDNWENPSTGSAGLGWEVWLDGMEITQFTYFQQVGGLATGPVTAEVTYGLERLASYIQEVDSVYDIEWANGVKYGEIFIQPEYEHSKYSFEISDQEMLLENFDKFEKEAGRALEEGLVHPAYDYVLKCSHTFNLLDARGAVSVTERAGYIARIRNLARVVAKTFVAERKRLGYPLLDEETRVKLLAEDAE

SEQ ID NO: 4517 - protein, 111 aa, Streptococcus pneumoniae
  misc_feature (B) LOCATION 1...111
  hypothetical: YES
EKILEGIRMKIVGVAACTVEIAHTYIAQEKLENAAKVAGHVIHVETQGTIGVENELSQEQIDAADVVILAVDVKISGMERFEGKKIIKVPTEVAVKSPNKLIAKAVEIVTK

SEQ ID NO: 4518 - protein, 61 aa, Streptococcus pneumoniae
  misc_feature (B) LOCATION 1...61
  hypothetical: YES
IIFMNIGLTFEHYSSKRSHIEKIKRGDYNKVNQGRREKKNGSGFSNRFRCDFWKSNRWLPF

SEQ ID NO: 4519 - protein, 295 aa, Streptococcus pneumoniae
  misc_feature (B) LOCATION 1...295
  hypothetical: YES
GVFMKNKFFLIAILAMCIVFSACSSNSVKNEENTSKEHAPDKIVLDHAFGQTILDKKPERVATIAWGNHDVALALGIVPVGFSKANYGVSADKGVLPWTEEKIKELNGKANLFDDLDGLNFEAISNSKPDVILAGYSGITKEDYDTLSKIAPVAAYKSKPWQTLWRDMIKIDSKALGMEKEGDELIKNTEARISKELEKHPEIKGKIKGKKVLFTMINAADTSKFWIYTSKDPRANYLTDLGLVFPESLKEFESEDSFAKEISAEEANKINDADVIITYGDDKTLEALQKGSSFR

SEQ ID NO: 4520 - protein, 88 aa, Streptococcus pneumoniae
  misc_feature (B) LOCATION 1...88
  hypothetical: YES
NPFILINTNHDDSGKQYMEQIRIVRQTLQNRDWNEKIKKTVRGFMIESYLADGRQNQPEVFGCSITDPCLGWENTEALVEEIYVTLTK

SEQ ID NO: 4521 - protein, 108 aa, Streptococcus pneumoniae
  misc_feature (B) LOCATION 1...108
  hypothetical: YES
LTFINWFFSTNTLYFIFWFRCFLYSLLFRSFWLLFWRDWCLFVFTWLDWFTYLFNFWFRLFFYSRRFNFWFFNRLISSLIFCFYYFWLCIFLFRCIFRSPIFFRIFWL

SEQ ID NO: 4522 - protein, 111 aa, Streptococcus pneumoniae
  misc_feature (B) LOCATION 1...111
  hypothetical: YES
RFFFFLKGKREQEVLMKASIALQVLPLAQGIDRIAVIDQVIAYLQTQEVTMVVTPFETVLEGEFDELMRILKEALEVAGQEADNVFANVKINVGEILSIDEKLEKYTETTH

SEQ ID NO: 4523 - protein, 68 aa, Streptococcus pneumoniae
  misc_feature (B) LOCATION 1...68
  hypothetical: YES
NHFILFENLFKPRQLHLAVYMLLTSSVLSTTSKRCFELTSSVLSTTSKHCFKQPAASFLVCSLIFIEY

SEQ ID NO: 4524 - protein, 210 aa, Streptococcus pneumoniae
  misc_feature (B) LOCATION 1...210
  hypothetical: YES
KNFMTDIKTLALKYGGYTSLDKVYLDQLLAGKTDQEQLTLITPPPSVVNAYFAELYQKKSPQAATDYFAELSQELNLYNTEPSFTLENKPFIRLNLSGKSFGFCYESDGLGRIFFENEEKISDDLLFEIAQIFPHQLVFEESGKIYMKPVEDEEVISLESLTALTDLERLADGRKRLKGYSQEDLLQEAAAFSGKRYFRSENRTAMLYID

SEQ ID NO: 4525 - protein, 84 aa, Streptococcus pneumoniae
  misc_feature (B) LOCATION 1...84
  hypothetical: YES
KVFLLISKARTTPKRLLVVNTKSADSMAISVPAPIAIPTSATLRAGASLIPSPTKATFPDCCSLWISWAFSSGKTPAMTSSIPI

SEQ ID NO: 4526 - protein, 184 aa, Streptococcus pneumoniae
  misc_feature (B) LOCATION 1...184
  hypothetical: YES
GVFMKLKLLRVDTKVIMGSFLLVLSSLLALLLPLILKGLIDGSSIENIGSKVFQSFLIFIGQALFSSIGYYLFSQSGEKKIAKIRKKVIEGLIYAEKSFFDKSQSGELTSAIVNDMSVIREFLITTFPNIILSLVMVLGSIVVLFSLDWNLSLLLFITLPCMMFIILPLSNISEKYSRRLQEEI

SEQ ID NO: 4527 - protein, 342 aa, Streptococcus pneumoniae
  misc_feature (B) LOCATION 1...342
  hypothetical: YES
KRFIFKTKMKRFKKEIKRQRQALSFLEKMKRFKKEVAMNSKAKQVSLWERIKKQKLLLLMTVPGLVLTFIFKYIPMYGVLIAFKDYNPLKGILGSDWIGFSEFTKFISSPNFGILLANTLKLSIYGLLLGFLPPIILAIMLNQLLSEKVKKRIQLILYAPNFISVVVIVGMIFLFFSVGGPINNFLSMFGMKADFLTNPDFFRPLYIFSGIWQGMGWASTLYTATLVNVDPALVEAARLDGANIFQRIWHIDIPALKPIMVIQFVLAAGGIMNVGYEKAFLMQTSLNLPTSEIISTYVYKVGLVSGDYSYSTAVGLFNAVIHVVLLVAVNQIVKRMNNGEGI

SEQ ID NO: 4528 - protein, 105 aa, Streptococcus pneumoniae
  misc_feature (B) LOCATION 1...105
  hypothetical: YES
KGFMKHLLSYFKPYIKESILAPLFKLLEAVFELLVPMVIAGIVDQSLPQGDQGHLWMQIGLLLIFAVIGVLVALIAQFYSAKAAVGLAIGIDKRSLSSYSFLAQA

SEQ ID NO: 4529 - protein, 104 aa, Streptococcus pneumoniae
  misc_feature (B) LOCATION 1...104
  hypothetical: YES
SHFFGGKKRGELSDFFEEEGGFHPPLIFGHHVPHLKTNFFRGDFGGGNTFFFKEGELEGVLKKNFFFKETPQRGTGGFFVPRGGDSSGVSLLEGGCKKWGCEVL

SEQ ID NO: 4530 - protein, 181 aa, Streptococcus pneumoniae
  misc_feature (B) LOCATION 1...181
  hypothetical: YES
WLLIICLWLAIIWFWFFWLRFNLWFWFFWLRFNLWFWFFRLRFNLWFWFFRLRFNLWFWFFRLRFNLWFWFFRLRFNLWFWFFRLRFNLWFWFFRLRFNLWFWFFRLRFNLWFWFFRLRFNLWFWFFRLRFNLWFWFFWLRFNLWFWFFQLRFNLWLRTWLHTWFWSRWFFVTWFFWCVLS

SEQ ID NO: 4531 - protein, 320 aa, Streptococcus pneumoniae
  misc_feature (B) LOCATION 1...320
  hypothetical: YES
EILMSISQRTTKLILATCLACLLAYFLNLSSAVSAGIIALLSLSDTRRSTLKLARNRLFSMLLALAIGVLAFHLSGFHIWSLGLYLAFYVPLAYKMGWEIGITPSTVLVSHLLVQESTSPDLLVNEFLLFAIGTGFALLVNLYMPSREEEIQHYHTLVEEKLKDILQRFKYYLSRGDGRNRAQLVAELDTLLKEALRLVYLDHSDHLFHQTDYHIHYFEMRQRQSRILRNMAQQINTCHLAASESLILAQLFSKIAGQLSQTNPASDLLDEIERYLEVFRNRSLPKTREEFETRATLLQLLREAKTFIQVKVDFYQKYRQ

SEQ ID NO: 4532 - protein, 317 aa, Streptococcus pneumoniae
  misc_feature (B) LOCATION 1...317
  hypothetical: YES
RYLIQRGIHMSIYNNITELIGQTPIVKLNNIVPEGAADVYIKLEAFNPGSSVKDRIALSMIEKAEQDGILKPGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVYAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYEFEV

SEQ ID NO: 4533 - protein, 266 aa, Streptococcus pneumoniae
  misc_feature (B) LOCATION 1...266
  hypothetical: YES
VDFFMKRFEVSTEIGSLSVAYQKQKKVLVCLNGAGLLPSYENFSLILEKPPPTIGYLTIDFPNTGRSPIYDQAGKNLDNLADVVYEALEELGISEYILCVHSWSGILACKLLEKPIKCQTLVVIEPTTKKVMFADFSENPYPEMEEQMRLIDECGPELYFKNLTQATFSPETNKKIWELMQEKGLELENQDPEFQISGEITEEDFENLSIESHVPVFIFCQTYREKEYRESEYWTSNTKLILGGNHHYLQWSESEKIAAIIRELSE

SEQ ID NO: 4534 - protein, 655 aa, Streptococcus pneumoniae
  misc_feature (B) LOCATION 1...655
  hypothetical: YES
NGLMNKRMNELVALLNRYATEYYTSDNPSVSDSEYDRLYRELVELETAYPEQVLADSPTHRVGGKVLDGFEKYSHQYPLYSLQDAFSREELDAFDARVRKEVAHPTYICELKIDGLSISLTYEKGILVAGVTRGDGSIGENITENLKRVKDIPLTLPEELDITVRGECYMPRASFDQVNQVRQENGEPEFANPRNAAAGTLRQLDTAVVAKRNLATFLYQEASPSTRDSQEKGLKYLEQLGFVVNPKRILAENIDEIWNFIQEVGQERENLPYDIDGVVIKVNDLASQEELGFTVKAPKWAVAYKFPAEEKEAQLLSVDWTVGRTGVVTPTANLTPVQLAGTTVSRATLHNVDYIAEKDIRKDDTVIVYKAGDIIPAVLRVVESKRVSEEKLDIPTNCPSCNSDLLHFEDEVALRCINPRCPAQIMEGLIHFASRDAMNITGLGPSIVEKLFAANLVKDVADIYRLQEEDFLLLEGVKEKSAAKLYQAIQASKENSAEKLLFGLGIRHVGSKASQLLLQYFHSIENLYQADSEEVASIESLGGVIAKSLQTYFATEGSEILLRELKETGVNLDYKGQTVVADAALSGLTVVLTGKLERLKRSEAKSKLESLGAKVTGSVSKKTDLVVVGADAGSKLQKAQELGIQVRDEAWLESL

SEQ ID NO: 4535 - protein, 185 aa, Streptococcus pneumoniae
  misc_feature (B) LOCATION 1...185
  hypothetical: YES
GFLMISFLLLLVLVWGFYIGYRRGLLLQVYYLISAMASAFMAGQFYKGLGEQFHLLLPYANSQEGQGTFFFPSDQLFQLDKVFYAGIGYLLVFGIVYSIGRLLGLLLHLIPSKKLGGKLFQVSAGILSMLVTLFVLQMALTILATIPMAVIQNPLEKSIVAKHIIQSIPITTSWLKQIWVTNLIG

SEQ ID NO: 4536 - protein, 801 aa, Streptococcus pneumoniae
  misc_feature (B) LOCATION 1...801
  hypothetical: YES
IMLISYKWLKELVDIDVPSQELAEKMSTTGIEVEGVESPAAGLSKIVVGEVLSCEDVPETHLHVCQVNVGEEERQIVCGAPNVRAGIKVMVALPGARIADNYKIKKGKIRGLESLGMICSLGELGISDSVVPKEFADGIQILPEDAVPGEEVFSYLDLDDEIIELSITPNRADALSMCGVAHEVAAIYDKAVNFKEFTLTETNEAAADALSVSIETDKAPYYAARILDNVTIAPSPQWLQNLLMNEGIRPINNVVDVTNYILLYFGQPMHAFDLDNFEGTDIRVREARAGEKLVTLDGEERDLDVNDLVITVADKPVALAGVMGGQATEISEKSSRVVLEAAVFNGKSIRKTSGRLNLRSESSSRFEKGINVATVNEALDAAASLIAELAGATVRKGIVSAGELDTSDVEVSSTLADVNRVLGTELSYADVEDVFRRLGFGLSGNADSFTVRVPRRRWDITIEADLFEEIARIYGYDRLPTSLPKDDGTAGELTATQKLRRQVRTIAEGAGLTEIITYTLTTPEKAVEFTAQPSNLTELMWPMTVDRSVLRQNMISGILDTVAYNVARKNKNLALYEIGKVFEQTGNPKEELPNEINSFAFALTGLVAEKDFQTAAVPVDFFYAKGILEALFTRLGLQVTYTATSEIASLHPGRTAVISLGDQVLGFLGQVHPVTAKAYDIPETYVAELNLSAIEAALQPATPFVEITKFPAVSRDVALLLKAEVTHQEVVDAIQAAGVKRLTDIKLFDVFSGEKLGLGMKSMAYSLTFQNPEDSLTDEEVARYMEKIQASLEEKVNAEVR

SEQ ID NO: 4537 - protein, 80 aa, Streptococcus pneumoniae
  misc_feature (B) LOCATION 1...80
  hypothetical: YES
FQLILSDILGTKELAALHGYILTAWTMAGLAXPILLAETYKMAHSYTQTLFVFLILYSIALALSYYLGRSIKKESQKPLT

SEQ ID NO: 4538 - protein, 100 aa, Streptococcus pneumoniae
  misc_feature (B) LOCATION 1...100
  hypothetical: YES
KQLIKKVGQAGKILADSGYQGLMKIYPQAQTPRKSSKLKPLTVEDKTYNHALSKERSKVENIFAKVETFKMFSTTCRNHRKRFGLRMNLSAGIINHELGF

SEQ ID NO: 4539 - protein, 260 aa, Streptococcus pneumoniae
  misc_feature (B) LOCATION 1...260
  hypothetical: YES
EELMIKDERVLELIEIIIKKKRIAVKELAEITFSSTSTLRRDLIFLENQGLIKRKHGYVTLSSMNTIELSHQIREGESTRQKRLIASLAKDFIRSGMCIYLDSSTTVYELCPYLSELDNLIIFTNGLHTAQTLSETVKDSSKIFITSGEVKHQSCSVVNYDKENSLLDHFNIDLAFCSARGIDDQYVYEASLSQAISKKNIIDKAHETILLIDSSKFYKTGFFKINPLSKYTTFISDTLPDQKLLDAVELFDGEWVSDIQ

SEQ ID NO: 4540 - protein, 654 aa, Streptococcus pneumoniae
  misc_feature (B) LOCATION 1...654
  hypothetical: YES
QFIIHSSKLQINAILKKKKLLLEGNKMVIRVFDQQKNTYSSFALEELSYYMNRVFKTNIELVEEKEADIFVGLVNKEDRKDHVLISLDKGKGRIESNTIVGLLIGIYRMFHEFGVVYTRPGRRHDFVPELRFEDFLDKELSIDETASYYHRGVCIEGADSFENILDFIDWLPKIGMNSFFIQFENPYSFLKRWYEHEFNPYLNKEKFSNELVQELSDRLDKELQKRGLIHHRVGHGWTGEVLGYSSKFGWESGLSISEEKKPYVAEINGKRELFNTAPILTSLDFSNPDVADKMVEIIKDYAKKRPDVNYLHVWLSDARNNICECENCRQELVSDQYIRILNQLDRALTSEGLDTKICFLLYHELLWAPQKEKLDNPERFTMMFAPITRTFEMSYADVDFDNSIPTPKPYLRNKIILPNSLEENLSYLFEWQKTFKGDSFVYDYPLGRAHYGDLGYMKISQTIYRDVSYLSNLHLNGYISCQELRAGFPHNFPNYVMGEMLWKKTRSYEELIEEYFSALYGENWQSVVEYLEKLSSYSSCDYFNAIGSRQNDVLANHYYIAYNLADNFLPIIEENISKLLNSQKDEWKQLSYHREYVVKMAKALYLQATGKTRQAQDEWRNVLNYIRGHELLFQSNLDVYRVIEVAKNYAGFHL

SEQ ID NO: 4541 - protein, 268 aa, Streptococcus pneumoniae
  misc_feature (B) LOCATION 1...268
  hypothetical: YES
EFIMVSSEFISKIEFACNKKESLYSQSKFKYAIRSMFAGAFLTFSTAAGAVGADLINKIAPGSGRFLFPFVFAWGLAYIVFLNAELVTSNMMFLTAGSFLKKISWRKTAEILLYCTLFNLIGALIAGWGFAHSAAYANLTHDSFISGVVEMKLGRSNELVLLEAILANIFVNIAILSFILVKDGGAKLWLVLSAIYMFVFLTNEHIAANFASFAIVKFSVAADSIANFGVGNMLRHWGVTFIGNFIGGGLLMGLPYAFLNKNEDTYVD

SEQ ID NO: 4542 - protein, 439 aa, Streptococcus pneumoniae
  misc_feature (B) LOCATION 1...439
  hypothetical: YES
RIIMKSRVKETSMDKIVVQGGDNRLVGYVTIEGAKNAVLPLLAATILASEGKTVLQNVPILSDVFIMNQVVGGLNAKVDFDEEAHLVKVDATGDITEVAPYKYVSKMRASIVVLGPILARVGHAKVSMPGGCTIGSRPIDLHLKGLEAMGVKISQTAGYIEAKAERLHGAHIYMDFPSVGATQNLMMAATLADGVTVIENAAREPEIVDLAILLNEMGAKVKGAGTETITITGVEKLHGTTHNVVQDRIEAGTFMVAAAMTGGDVLIRDAVWEHNRPLIAKLLEMCVEVIEEDEGIRVRSQLENLKAVHVKTLPHPGFPTDMQAQFTALMTVAKGESTMVETVFENRFQHLEEMRRMGLHSEIIRDTARIVGGQPLQGAEVLSTDLRASAALILTGLVAQGETVVGKLVHLDRGYYGFHEKLAQLGAKIQRIEASDEDE

SEQ ID NO: 4543 - protein, 939 aa, Streptococcus pneumoniae
  misc_feature (B) LOCATION 1...939
  hypothetical: YES
FVIIYKGDTMKLKDTLNLGKTEFPMRAGLPTKEPVWQKEWEDAKLYQRRQELNQGKPHFTLHDGPPYANGNIHVGHAMNKISKDIIVRSKSMSGFYAPFIPGWDTHGLPIEQVLSKQGVKRKEMDLVEYLKLCREYALSQVDKQREDFKRLGVSGDWENPYVTLTPDYEAAQIRVFGEMANKGYIYRGAKPVYWSWSSESALAEAEIEYHDLVSTSLYYANKVKDGKGVLDTDTYIVVWTTTPFTITASRGLTVGADIDYVLVQPAGEARKFVVAAELLTSLSEKFGWADVQVLETYRGQELNHIVTEHPWDTAVEELVILGDHVTTDSGTGIVHTAPGFGEDDYNVGIANNLEVAVTVDERGIMMKNAGPEFEGQFYEKVVPTVIEKLGNLLLAQEEISHSYPFDWRTKKPIIWRAVPQWFASVSKFRQEILDEIEKVKFHSEWGKVRLYNMIRDRGDWVISRQRAWGVPLPIFYAEDGTAIMVAETIEHVAQLFEEHGSSIWWERDAKDLLPEGFTHPGSPNGEFKKETDIMDVWFDSGSSWNGVVVNRPELTYPADLYLEGSDQYRGWFNSSLITSVANHGVAPYKQILSQGFALDGKGEKMSKSLGNTIAPSDVEKQFGAEILRLWVTSVDSSNDVRISMDILSQVSETYRKIRNTLRFLIANTSDFNPAQDTVAYDELRSVDKYMTIRFNQLVKTIRDAYADFEFLTIYKALVNFINVDLSAFYLDFAKDVVYIEGAKSLERRQMQTVFYDILVKITKLLTPILPHTAEEIWSYLEFETEDFVQLSELPEAQTFANQEEILDTWAAFMDFRGQAQKALEEARNAKVIGKSLEAHLTVYPNEVVKTLLEAVNSNVAQLLIVSDLTIAEGPAPEAALSFEDVAFTVERAAGEVCDRCRRIDPTTAERSYQAVICDHCASIVEENFADAVAEGFEEK

SEQ ID NO: 4544 - protein, 109 aa, Streptococcus pneumoniae
  misc_feature (B) LOCATION 1...109
  hypothetical: YES
FSIIVENGLGAMDTPDENGYVADNYRITYLEAHIKAMRDAIYQDGVDLLGYTTWSCIDPVSAGTGEMNKRYGFIYVDRDNVGNGALKRSKKKSFYWYKDVIDSNGASIG

SEQ ID NO: 4545 - protein, 98 aa, Streptococcus pneumoniae
  misc_feature (B) LOCATION 1...98
  hypothetical: YES
VLIIFKAKAWLDMRERSATGAQGLSKSIKKHLNDITRLTASLLGDEKLSAITSSSAVKADMHRFVIELELVKSTILQNDDISLDQNEIFEILKNFFDG

SEQ ID NO: 4546 - protein, 119 aa, Streptococcus pneumoniae
  misc_feature (B) LOCATION 1...119
  hypothetical: YES
MSIILTTIVALEHFYIFYLESIATQSDATSRVFNMEKEELAHPSVSSLFKNQGIYKALLGVFLLYVIYFSQNLEIVTIFVLFVIGAATYGSLTADKKIILKQGGSAILALISILLFKYT

SEQ ID NO: 4547 - protein, 267 aa, Streptococcus pneumoniae
  misc_feature (B) LOCATION 1...267
  hypothetical: YES
CQIIEWRSFKMIDKVIEQYKSHDNLDIRVELHKKYSKNKLGFNNWIFSNYQITDEVKVLELGCGTGELWKSNSDSIDKMKQLIVTDFSKDMVKSTKSVIGNRNNVNYEIMDIQKISFENETFDIVIANMLLHHVNDIPKALSEVNRVLKTGGIFYCATFGENGVVNYLASLFKDEVNQDLENRTFTLQNGKRYLSRYFNSVDTLLYDDELQVTSIDDLVKYIQSFKGISEIGSLEEEIIRKRLESEFNNGMLIIPKEYGMFIARKES

SEQ ID NO: 4548 - protein, 271 aa, Streptococcus pneumoniae
  misc_feature (B) LOCATION 1...271
  hypothetical: YES
SQIMKNNEYKYGGVLMTKPYYNKNKMILVHSDTFKFLSKMKPESMDMIFADPPYFLSNGGISNSGGQVVSVDKGDWDKISSFEEKHEFNRKWIRLAKEVLKPNGTVWISGSLHNIYSVGMALEQEGFKILNNITWQKTNPAPNLSCRYFTHSTETILWARKNDKKARHYYNYDLMKELNDGKQMKDVWTGSLTKKVEKWAGKHPTQKPEYLLERIILASTKEGDYILDPFVGSGTTGVVAKRLGRRFIGIDAEKEYLKIARKRLEAENETN

SEQ ID NO: 4549 - protein, 211 aa, Streptococcus pneumoniae
  misc_feature (B) LOCATION 1...211
  hypothetical: YES
PKIIKGSSVDIEDNVAAPRLPICQNLNLSKTLLFGKIKKLTKLLKAILTQVPDKASFIGVRPAFPLTAIAYTKITLTKPPMIAKLIWLMLDEIPKKERPITTLRLAPVFIPSIPGSAIGFLVTDCINTPLMARLEPAKIAKIVLGILLYIIDLIKSSFVLPIPKAAKKSLILISFVPSFNDKNIVIRRPRQITKIMPRCICVLFRIFACIS

SEQ ID NO: 4550 - protein, 302 aa, Streptococcus pneumoniae
  misc_feature (B) LOCATION 1...302
  hypothetical: YES
EEIMTFKSGFVAILGRPHVGKSTFLNHVMGAKIAIMSDKAQTTRNKIMGIYTTDKEQIVFIDTPGIHKPKTALGDFMVESAYSTLREVDTVLFMVPADEARGKGDDMIIERLKAAKVPVILVVNKIDKVHPDQLLSQIDDFRNQMDFKEIVPISALQGNNVSRLVDILSENLDEGFQYFPSDQITDHPERFLVSEMVREKVLHLTREEIPHSVAVVVDSMKRDEETDKVHIRATIMVERDSQKGIIIGKGGAMLKKIGSMARRDIELMLGDKVFLETWVKVKKNWRDKKLDLADFGYNEKEY

SEQ ID NO: 4551 - protein, 442 aa, Streptococcus pneumoniae
  misc_feature (B) LOCATION 1...442
  hypothetical: YES
RLIMGDKKYTVEKANRFIAENKHLVNTQYKPEEHFSAEIGWINDPNGFVYFRGEYHLFYQFYPYDSVWGPMHWGHAKSKDLVTWEHLPVALAPDQDYDRNGCFSGSAIVKDDRLWLMYTGHIEEKTGVRQVQNMAFSDDGIHFEKISQNPVVTGTDLPDELIAADFRDPKLFEKDGRYYSVVAVKHMDNVGCIVLLGSDNLVEWQFESIFLKGGEHQGFMWECPDYFELDGKDCLIMSPMRYQREGDSYHNINSSLLFTGKVDWREKRFIPESVQEIDHGQDFYAPQTLLDDQNRRILIAWMQTWGRTLPTHDQEHKWACAMTLPRILRLEDGKLRQFPVKKGQYQIQIDKDCHYHLGNDIDYLEFGYDSNAQQVYIDRSHLIQKILGEEEQDTSRRYVDIEAKELEVVLDKNSIEIFVNQGEASLTATYYLTVPAELSRID

SEQ ID NO: 4552 - protein, 170 aa, Streptococcus pneumoniae
  misc_feature (B) LOCATION 1...170
  hypothetical: YES
IMIIKVEMADVEVLAKIAKQTFRETFAYDNTEEQLQEYFEEAYSLKTLSTELGNPDSETYFIMHEEEIAGFLKVNWGSAQTERELEDAFEIQRLYVLQKFQGFGLGKQLFEFALELATKNSFSWAWLGVWEHNTKAQAFYNRYGFEKFSQHHFMVGQKVDTDWLLRKKLR

SEQ ID NO: 4553 - protein, 241 aa, Streptococcus pneumoniae
  misc_feature (B) LOCATION 1...241
  hypothetical: YES
SVIILKEFKPMSLLAFENVSKSYGATPALENVSLDIPAGKIVGLLGPNGSGKTTLIKLINGLLQPDQGRVLINDMDPSPATKAVVAYLPDTTYLNEQMKVKEALTYFKTFYKDFNLERAHHLLADLGIDENSRLKKLSKGNKEKVQLILVMSRDARLYVLDEPIGGVDPAARAYILNTIINNYSPTSTVLISTHLISDIEPILDEIVFLKDGKVVRQGNVDDIRYESGESIDQLFRQEFKA

SEQ ID NO: 4554 - protein, 80 aa, Streptococcus pneumoniae
  misc_feature (B) LOCATION 1...80
  hypothetical: YES
EKIIDSYRLSQMISNHVSLLLSKDAKAFEFWEYAPELFVEEQQAVEQERQKQALLLHKERMREFAERHNRKRKEEVNGNS

SEQ ID NO: 4555 - protein, 208 aa, Streptococcus pneumoniae
  misc_feature (B) LOCATION 1...208
  hypothetical: YES
NEIIEWRRNRWRTIMSEEINATVSTESTETVDTQGNVDSVQEEKHERTFTRAEIGKMLSAERSKWEAEQEAKENEAKKLAKMNADEKQKYQLDQREQELADREKAIARKELTAEAKAMLSERDLPVELVNVVDLTSAETVSQSVAVLQKSWEQAVQKGVQEKLKGGAPMKQAPVDSDGITKEEFARMGYQSRNELYQKNPELYKKLKG

SEQ ID NO: 4556 - protein, 365 aa, Streptococcus pneumoniae
  misc_feature (B) LOCATION 1...365
  hypothetical: YES
REIIMMDSPKKLGYHMPAEYEPHHGTLMIWPTRPGSWPFQGKAAKRAFTQIIETIAEGERVYLLVEQAYLSEAQSYLGDKVVYLDIPTNDAWARDTGPTILVNDKGKKLAVDWAFNAWGGTYDGLYQDYEEDDQVASRFAEALGRPVYDAKPFVLEGGAIHSDGQGTILVTESCLLSPGRNPNLTKEEIENTLLESLGAEKVIWLPYGIYQDETNEHVDNVAAFVGPAELVLAWTDDENDPQYAMSKADLELLEQETDAKGCHFTIHKLPIPAVRQVVTEEDLPGYIYEEGEEKRYAGERLAASYVNFYIANKAVLVPQFEDVNDQVALDILSKCFPDRKVVGIPARDILLGGGNIHCITQQIPE

SEQ ID NO: 4557 - protein, 144 aa, Streptococcus pneumoniae
  misc_feature (B) LOCATION 1...144
  hypothetical: YES
SHFLRVFIGQKEWNKISENHQIKEDDKDLVPNTIGLTPFVFVKGTRNTVCAFDQFFSEGFFFHEFAPFLKIFLPKETVEVSLEAAGEIETEFQSWIVLVVFNHIDGLSRDTDILGELELGNAQFLAKFFHTIHLVSFLICVVYI

SEQ ID NO: 4558 - protein, 141 aa, Streptococcus pneumoniae
  misc_feature (B) LOCATION 1...141
  hypothetical: YES
EFVMDLLEKECLKCDKNFQQGDIWNYYYLSDKVPAQGWKIHISSQIKDAVNIFKIVYKLSQLNNCSFKVVKNLEELKKINSPREMSPTANKFITLYPKSESEAKSMICNLTNRLSEFKAPKILSDYQCGMHSLVHYRYGAF

SEQ ID NO: 4559 - protein, 230 aa, Streptococcus pneumoniae
  misc_feature (B) LOCATION 1...230
  hypothetical: YES
ECVMKVLAFDTSSKALSLAILEDKQVLAETTINIKKNHSITLMPAIDFLMESLDWTPKDLDRIVVAEGPGSYTGLRIAVATAKTLTHTLNIELVGMSSLLALVPYQQEGLFVPLMDARRNNVYAGFYENAKPVMPEAHLSFEEVLEKVKGASQVTFVGEVAPFVEQIQEHLPRTNYKETLPNAANLALLAWDKEADSLHDFVPNYLKRVEAEENWLKNHTESGESYIKRL

SEQ ID NO: 4560 - protein, 468 aa, Streptococcus pneumoniae
  misc_feature (B) LOCATION 1...468
  hypothetical: YES
SRVIRSGKCLRLLITYTELGEFMNVAWILLYTLVTHGLKIVIFFKVDGISLTFERIFKAFLFKILLAVVFGMLGYMVGNVYLSYFMEPLYGIGLSFLLLRELPKKLLLFYGLFPMILVNLFYRGVSYFVLPFLGQGQVYDDYSFIWLCIIIFNFFISLAFLKWLDYDFTSLRKGILDKDFQKSLTQINWIMGAYYLVIQNLSYFEYEQGIQSTTVRHLILVFYLLFFMGIIKKLDTYLKDKLHERLNQEQDLRYREMERYSRHIEELYKEVRSFRHDYTNLLTSLRLGIEEEDMEQIKEIYDSVLKDSSEKLQDNKYDLGRLVNVRDRALKSLLAGKFIKARDKNIVFNVEVPEEIQVEGVSLLDFLTVVSILCDNAIEASVEACQPHVSIAFFKNGAQETFIIENSIKEEGIDISEIFSFGASSKGEERGVGLYTVMKIVESHPNTSLNTTCQDHVFRQVLTVIHIE

SEQ ID NO: 4561 - protein, 170 aa, Streptococcus pneumoniae
  misc_feature (B) LOCATION 1...170
  hypothetical: YES
LTVILSYQVSGLRRLRVWPFIRLGCLLMMSMNLQKISFSAKRELTYCSICGRLTDDDPCSICTDPTRDQTTILVLEDSRDVAAMENIQEYHGLYHVLHGLISPMNGISPDDINLKSLMTRLMDSEVSEVIVATNATADGEATSMYLSRLLKPAGIKVTRLDTRSRCGSGH

SEQ ID NO: 4562 - protein, 112 aa, Streptococcus pneumoniae
  misc_feature (B) LOCATION 1...112
  hypothetical: YES
TRVMTRKVYDTDLNDQEWAKIEPYFSKHRTYKWPKRVLVNETLYVTKTGCQWRMLPHDFPLYLMVWSFFRRSMTTGWFQVNGRWYYAYSSGALAVNTTVDGYSVNYNGEWVR

SEQ ID NO: 4563 - protein, 596 aa, Streptococcus pneumoniae
  misc_feature (B) LOCATION 1...596
  hypothetical: YES
RRVIIMTQGKITASAAMLNVLKTWGVDTIYGIPSGTLSSLMDALAEDKDIRFLQVRHEETGALAAVMQAKFGGSIGVAVGSGGPGATHLINGVYDAAMDNTPFLAILGSRPVNELNMDAFQELNQNPMYNGIAVYNKRVAYAEQLPKVIDEACRAAISKKGPAVVEIPVNFGFQEIDENSYYGSGSYERSFIAPALNEVEIDKAVEILNNAERPVIYAGFGGVKAGEVITELSRKIKAPIITTGKNFEAFEWNYEGLTGSAYRVGWKPANEVVFEADTVLFLGSNFPFAEVYEAFKNTEKFIQVDIDPYKLGKRHALDASILGDAGQAAKAILDKVNPVESTPWWRANVKNNQNWRDYMNKLEGKTEGELQLYQVYNAINKHADQDAIYSIDVGNTTQTSTRHLHMTPKNMWRTSPLFATMGIALPGGIAAKKDNPDRQVWNIMGDGAFNMCYPDVITNVQYDLPVINLVFSNAEYGFIKNKYEDTNKHLFGVDFTNADYAKIAEAQGAVGFTVDRIEDIDAVVAEAVKLNKEGKTVVIDARITQHRPLPVEVLELDPKLHSEEAIKAFKEKYEAEELVPFRLFLEEEGLQSRAIK

SEQ ID NO: 4564 - protein, 169 aa, Streptococcus pneumoniae
  misc_feature (B) LOCATION 1...169
  hypothetical: YES
MTVIIKSMETPEEIEGKSLVHWQTWREAYDDLLPAEFQETMTLERCRFFSQKYPENTLIAIGDLKVVGFISYGNFRDETIQAGEIIALYVLKDYYGKGIAQKLMKAALTALNHFSEIFLWVLKDNKRAIAFYQKMGFTFDGQEKILELGKPIKEKRMVFYSKIILKSRS

SEQ ID NO: 4565 - protein, 247 aa, Streptococcus pneumoniae
  misc_feature (B) LOCATION 1...247
  hypothetical: YES
RKVIIMKLNKLNFLKENIRNLYSSGVIYLSLLISFIPPILLTFFILKTQGTSLGIKHISNFYAMLGMLMAVIHANRVISRDFSHNTVSLFYNQQKNRMIYVLSNFLYAISVSIIYALNGIVLLVIVSKLGIPGDLGLDFIVAIVVNTILLVLFYFLLSYIFYLYKLKSGLVFGILVALLLFIPNILNTMMMNTSNDLFIKAIELLPFYSLPVFVASNTMSISQYLVLITTIILLYFFTLKKSKKYSF

SEQ ID NO: 4566 - protein, 317 aa, Streptococcus pneumoniae
  misc_feature (B) LOCATION 1...317
  hypothetical: YES
ERVMPIRIDKKLPAVEILRTENIFVMDDQRAAHQDIRPLKILILNLMPQKMVTETQLLRHLANTPLQLDIDFLYMESHRSKTTRSEHMETFYKTFPEVKDEYFDGMIITGAPVEHLPFEEVDYWEEFRQMLEWSKTHVYSTLHICWGAQAGLYLRYGVEKYQMDSKLSGIYPQDTLKEGHLLFRGFDDSYVSPHSRHTEISKEEVLNKTNLEILSEGPQVGVSILASRDLREIYSFGHLEYDRDTLAKEYFRDRDAGFDPHIPENYFKDDDVNQVTCLCWSSSAALFFSNWVNHAVYQETPFDWRKIEDDASAYGYL

SEQ ID NO: 4567 - protein, 326 aa, Streptococcus pneumoniae
  misc_feature (B) LOCATION 1...326
  hypothetical: YES
THSIECDKGEFMANRKIVVALGGNAILSSDPSAKAQQEALVETAKHLVKLIKNGDDLIITHGNGPQVGNLLLQHLASDSEKNPAFPLDSLVAMTEGSIGFWLKNALQNALLDEGIEKNVASVVTQVIVDKNDPAFVNLSKPIGPFYSEEEAKAEAEKSGATFKEDAGRGWRKVVASPKPVDIKEIETIRTLLNNGQVVVAAGGGGIPVVKENNGHLTGVEAVIDKDFASQRLAELVDADLFIVLTGVDYVFVNYNKPNQEKLEHVNVAQLEEYIKQDQFAPGSMLPKVEAAIAFVNGRPEGKAVITSLENLGALIESESGTIIEKG

SEQ ID NO: 4568 - protein, 71 aa, Streptococcus pneumoniae
  misc_feature (B) LOCATION 1...71
  hypothetical: YES
CFSIIHILPFSCKRFLCFYYTTFLEKIQVNYYTSLIILKIYNKFTYSFNCKSIFFQKIAKTPFFFYYSEMK

SEQ ID NO: 4569 - protein, 74 aa, Streptococcus pneumoniae
  misc_feature (B) LOCATION 1...74
  hypothetical: YES
FQSIISIMHTTIGSNKNHNKFIHRWLPQGTKKTTTKEVAFIEKWINNYPKKCLNYKSPREDFWMTNLNLKFSNN

SEQ ID NO: 4570 - protein, 237 aa, Streptococcus pneumoniae
  misc_feature (B) LOCATION 1...237
  hypothetical: YES
IMSIHIAAQQGEIADKILLPGDPLRAKFIAENFLGDAVCFNEVRNMFGYTGTYKGHRVSVMGTGMGMPSISIYARELIVDYGVKKLIRVGTAGSLNEEVHVRELVLAQAAATNSNIVRNDWPQYDFPQIASFDLLDKAYHIAKELGMTTHVGNVLSSDVFYSNYFEKNIELGKWGVKAVEMEAAALYYLAAQYHVDALAIMTISDSLVNPDEDTTAEERQNTFTDMMKVGLETLIAE

SEQ ID NO: 4571 - protein, 497 aa, Streptococcus pneumoniae
  misc_feature (B) LOCATION 1...497
  hypothetical: YES
LWSIERKDMYQYLTYPRDGYDEGSLKKDLIYKLITIHNTESSRLKNLKSYYMGDHAILNHKRRNVNAPNYKTVANHAKDIADTATGYFMGNPIKYNNTADGDIDELLTAFDGAEIDQVDAQNALNMAIYGRAYEYIYAKEGMTELDSTSIDPENTFMVYDDSIERKPLFAVYYYEVKDDTKDTTKHQAEVFTENLHYHMVLRSTDSGTTQSEEATPHNLGQIPIIEYRNNHFAIGDYEQQISLIDAYNSLMGNRVNDKEQAVESILVLYGTQLADTPEDAKVAMKILSEEGLLELPGDSARAEFLKNTLDESATEILRTALKEDIYTFSHVPNLTDENFAGNTSGVAMEFKLMGLEMITKTKEANYKRGLRQRIAIFAHYLGMKQIALESHSIVPQFSRGLPKNLLEISQIVNNLEGKVTNRQLISLLPFVEDPDAELEALEEEKKKNMEDMPMFNKDNTKPEDEVEDEESGVLGEEESQSDLPADGQGRKAGRPVR

SEQ ID NO: 4572 - protein, 370 aa, Streptococcus pneumoniae
  misc_feature (B) LOCATION 1...370
  hypothetical: YES
GVPMAKTIYIAGLGLIGASMALGIKRDHPDYEILGYNRSQASRDIALKEGMIDRATDDFASFAPLADVIILSLPIKQTIAFIKELANLDLREGVIISDAGSTKSTIVDAAEQYLAGKSVRFVGAHPMAGSHKTGAASADVNLFENAYYIFTPSSLTSQDTLKEMKDLLSGLHARFIEIDAKEHDRVTSQISHFPHILASSLMEQTAVYAQEHEMARRFAAGGFRDMTRIAESEPGMWTSILLSNSETILDRIEDFKERLEAIGQAISKGDEEQIWNFFNQAREQRQTMEIHKRGGVDSSYDLYVDVPDEEDVILRILELLRGTSLVNIHINEENREDIHGILQISFKNAQDLERAEHLITENTDYTVVIK

SEQ ID NO: 4573 - protein, 204 aa, Streptococcus pneumoniae
  misc_feature (B) LOCATION 1...204
  hypothetical: YES
QVPMSLREKSMSEYKLSENNWTRVAVFAGGNRGHYRTDFDAFVGVDRGSLWVLEEDLPLALAVGDFDSVTEEERQVIQKRAQYFVQARPEKDDTDLELALLTIFEKNPQAQVTIFGALGGRIDHMLANVFLPSNPKXXXXXXXXXXXXXKKXXXXXXXXXGXXGXGXXGGGGGGGXGGGGGGGGXGXGGGGXGGGGGXGGGGGG

SEQ ID NO: 4574 - protein, 95 aa, Streptococcus pneumoniae
  misc_feature (B) LOCATION 1...95
  hypothetical: YES
KYPMYNDVIERISLYEFIGDIFYSKIISCCIVASDLSKNTMKLDVIFFEDKNKRSAVLGLRRDKSGVFKPVTLHFTSAKKYAKVRKTDVKEMKWL

SEQ ID NO: 4575 - protein, 85 aa, Streptococcus pneumoniae
  misc_feature (B) LOCATION 1...85
  hypothetical: YES
NVFFNVTMNCKISLLSLVWMSFLMKKRPWLLAPVVSSSSCHKTSTLRNNLLVSQVLMFQLLKLYVALRKSLMVNTTTCQKMPSVV

SEQ ID NO: 4576 - protein, 63 aa, Streptococcus pneumoniae
  misc_feature (B) LOCATION 1...63
  hypothetical: YES
IEPILSQNIRESYVGFQKNTFNTLRKSLQTTSVLSATSKLCFEQPAASFLVCSLIFIEYNSKK

SEQ ID NO: 4577 - protein, 222 aa, Streptococcus pneumoniae
  misc_feature (B) LOCATION 1...222
  hypothetical: YES
EVTMESILEILTPDNLVFIFKGFGLTLYISLIAIILSTIIGTVLAVMRNGKNPILRIISSIYIEFVRNVPNLLWIFTIFLVFKMKSTPAGITAFTLFTSAALAEIIRGGLNAVNKGQYEAGMSQGFTSAQILYYIILPQAIRKMLPAIISQFVTVIKDTSLLYSVIALQELFGASQILMGRYFEPEQVFSLYILIALIYFSFNLAISNLSHMLAKRWQQAAE

SEQ ID NO: 4578 - protein, 61 aa, Streptococcus pneumoniae
  misc_feature (B) LOCATION 1...61
  hypothetical: YES
HYTIPAAGVEPARPCGHWILSPARLPIPPRRQIVTGVAGFEPTHEGVKVPCLTAWLYPNIK

SEQ ID NO: 4579 - protein, 563 aa, Streptococcus pneumoniae
  misc_feature (B) LOCATION 1...563
  hypothetical: YES
YNTMEYNHKERTMSFDGFFLHHIVEELRSELVNGRIQKINQPFEQELVLQIRSNRQSHRLLLSAHPVFGRIQLTQTTFENPAQPSTFIMVLRKYLQGALIESIEQVENDRIVEITVSNKNEIGDHIQATLIIEIMGKHSNILLVDKSSHKILEVIKHVGFSQNSYRTLLPGSTYIAPPSTESLNPFTIKDEKLFEILQTQELTAKNLQSLFQGLGRDTANELERILVSEKLSAFRNFFNQETKPCLTETSFSPVPFANQVGEPFANLSDLLDTYYKDKAERDRVKQQASELIRRVENELQKNRHKLKKQEKELLATDNAEEFRQKGELLTTFLHQVPNDQDQVILDNYYTNQPIMIALDKALTPNQNAQRYFKRYQKLKEAVKYLTDLIEETKATILYLESVETVLNQAGLEEIAEIREELIQTGFIRRRQREKIQKRKKLEQYLASDGKTIIYVGRNNLQNEELTFKMARKEELWFHAKDIPGSHVVISGNLDPSDAVKTDAAELAAYFSQGRLSNLVQVDMIEVKKLNKPTGGKPGFVTYTGQKTLRVTPDSKKIASMKKS

SEQ ID NO: 4580 - protein, 149 aa, Streptococcus pneumoniae
  misc_feature (B) LOCATION 1...149
  hypothetical: YES
RCTILVSIYYKIGLSSSGVYKAVADGEMTVGLSYEDPAVKLLNDGANIKVVYPKEGTVFLPASAAIVKKSKNMENAKKFIDFIISQEVQDTLGTTTTNRPVRKNAKTSENMKPIDKIKTLTEDYDYVIKNKSDIVKKYNEVFTDIQSKQ

SEQ ID NO: 4581 - protein, 79 aa, Streptococcus pneumoniae
  misc_feature (B) LOCATION 1...79
  hypothetical: YES
RCTILVSIYYIMDNARFHRMGKLELLCEEFGHKLLPLLPYSPEYNPIEKTWAHIKKNLKKVLPRCHTFYEALLSCSCFN

SEQ ID NO: 4582 - protein, 60 aa, Streptococcus pneumoniae
  misc_feature (B) LOCATION 1...60
  hypothetical: YES
RCTILVSIYYIMDNARFHRMGKLELLCEEFGHKLLPLPPYSSEYILLRKHGLISKSTSKR

SEQ ID NO: 4583 - protein, 81 aa, Streptococcus pneumoniae
  misc_feature (B) LOCATION 1...81
  hypothetical: YES
NTTIISISSCFSTLFKTFLKDKEKIVNALQLPYSNAKLEATNNLIKLIKHNAFGFRNFENFKKERTKFVLSRSSLSSTHYS

SEQ ID NO: 4584 - protein, 98 aa, Streptococcus pneumoniae
  misc_feature (B) LOCATION 1...98
  hypothetical: YES
FETIYLFRTKEKDLKQTSQILCIACFIALFQLDGSNALLVILISDYGLLLEKTITDSSQLFPCSSGTTASVFPRLARTFKTVSNCGLVLPVSILAITG

SEQ ID NO: 4585 - protein, 547 aa, Streptococcus pneumoniae
  misc_feature (B) LOCATION 1...547
  hypothetical: YES
VETMTEIVKASLENGIQKIRIRAEKGYHPAHIQLQKGIPAEITFHRATPSNCYKEILFEEEGILEPIGVDEEKVIRFTPQELGRHEFSCGMKMQKGSYIVVEKTRKSLSLLQRFWITSIFTVPLVILMIGMLTGSISHQVMHWGTFLATTPIMLVAGKPYIQSAWASFKKHNANMDTLVALGTLVAYFYSLVALFAGLPVYFESAGFILFFVLLGAVFEEKMRKNTSQAVEKLLDLQAKTAEVLSDDSYVQVPLEQVKVGDLIRVRPGEKIAVDGVVVEGVSSIDESMVTGESLPVDKTVGDTVIGSTINHSGTLVFRAEKVGSETVLAQIVDFVKKAQTSRAPIQDLTDKISGIFVPVVVILGIMTFWVWFVLLRDSVVVLGASFVSSLLYGVAVLIIACPCALGLATPTALMVGTGRSAKMGVLLKNGTVLQEIQKVQTLVFDKTGTLTEGKPVVTDIIGDEVEVFGLAASLEDASQHPLAEAIVKRASEAGLEFKTVENFQALHGKGVSGRINGKQVLLGNAKMLDGMDISNTYRDKLEELEKG

SEQ ID NO: 4586 - protein, 98 aa, Streptococcus pneumoniae
  misc_feature (B) LOCATION 1...98
  hypothetical: YES
GVAMKLSNLLLFAGAAAGSYLVTKNRQTITDEVLNTTDRVQAIKDDVDIIQNSLQIIDQQKELIKEYQEDLTYKFKVLEKDIQTRLAVIKEMQGTEDK

SEQ ID NO: 4587 - protein, 194 aa, Streptococcus pneumoniae
  misc_feature (B) LOCATION 1...194
  hypothetical: YES
KNAIMKGMKYHDYIWDLGGTLLDNYETSTAAFVETLALYGITQDHDSVYQALKVSTPFAIETFAPNLENFLEKYKENEARELEHPILFEGVSDLLEVISNQGGRHFLVSHRNDQVLEILEKTSIAAYFTEVVTSSSGFKRKPNPESMLYLREKYQISSGLVIGDRPIDIEAGQAAGLDTHLFTSIVNLRQVLDI

SEQ ID NO: 4588 - protein, 355 aa, Streptococcus pneumoniae
  misc_feature (B) LOCATION 1...355
  hypothetical: YES
KNAIIERTISKENKMTKPIILTGDRPTGKLHIGHYVGSLKNRVLLQEEDKYDMFVFLADQQALTDHAKDPQTIVESIGNVALDYLAVGLDPNKSTIFIQSQIPELAELSMYYMNLVSLARLERNPTVKTEISQKGFGESIPTGFLVYPIAQAADITAFKANYVPVGTDQKPMIEQTREIVRSFNNAYNCDVLVEPEGIYPDNERAGRLPGLDGNAKMSKSLNNGIYLADDADTLRKKVMSMYTDPDHIRVEDPGKIEGNMVFHYLDVFGRPEDAQEIADMKERYQRGGLGDVKTKRYLLEILERELGPIRERRIEFAKDMGEVYNMIQKGSERAREVAGQTLSEVKGAMGLHYFN

SEQ ID NO: 4589 - protein, 146 aa, Streptococcus pneumoniae
  misc_feature (B) LOCATION 1...146
  hypothetical: YES
KCAIIEGGKGGFSDIRVSAQLMICQFIRDMLDLPAKNVTILEGSNIHVLPSMPYSAQDFYTSIDVLAELDNGIQVIIEIQVHHQNFFINRLWAYLCSQVNQNLEKIRQREGDTHQSYKQIAPVYAIAIVDSNYFSDDLAFHSFIVK

SEQ ID NO: 4590 - protein, 163 aa, Streptococcus pneumoniae
  misc_feature (B) LOCATION 1...163
  hypothetical: YES
YNAIQVGFDDKREVLSNKPAKGHVAKANTAPKRFIREFKNVEGLEVGAEITVETFAAGDVVDVTGTSKGKGFQGVIKRHGQSRGPMAHGSRYHRRPGSMGPVAPNRVFKGKNLAGRMGGDRVTIQNLEVVQVVPEKNVILIKGNVPGAKKSLITIKSAVKAGK

SEQ ID NO: 4591 - protein, 61 aa, Streptococcus pneumoniae
  misc_feature (B) LOCATION 1...61
  hypothetical: YES
NLILYSSKISSSHVSIALPYVWLLTSSVSSTTSKQCFEQPAASFLVCSLILSIRFTQNQGF

SEQ ID NO: 4592 - protein, 567 aa, Streptococcus pneumoniae
  misc_feature (B) LOCATION 1...567
  hypothetical: YES
KNYIEVNTMSKEKIKVYLYTRVSTSIQIEGYSLEAQKSRMKAFAIYNDYEIVGEYEDAGKSGKSIEGRIQFNRMMEDIKSGKDGVSFVLVFKLSRFARNAADVLSTLQIMQDYGVNLICVEDGIDSSKDAGKLMISVLSAVAEIERENIRIQTMEGRIQKAREGKWNGGFAPYGYKLEDGKLFINEEEAVAIRTIFDQYVNTTIGANGISKYLENHGIRKIPRQNGKNPLFDAGLIRKILKNPVYNGKIAFGRRTLEKVHGTRNEYKQVEQDEYLISEGIHEAIVSDEVWQAAQVKLKSQAKKYEHVNKGKDTRTHLLSGIVKCPICGVGMFGNKCIKKKKDGTKYKDFYYYGCKHRQMIRGHKCTFSKQIREELLDDAVAEVIVKIVSNPKFASMMQEKINMKVDTSEIEKEIDNYQKELRKSHSTKFKLIEEIDNLDVEDKHYKRRKQDLDDRLYRMYDKIDELESSLIDAKAKKQTIEAEKLTGDNIYKVLIYFDKLYKVMNDVERRQLISALISEIQVYEEKQSNGQWLKSITFKLPIIEENLNIGLDNDEQVECVSLLEKRS

SEQ ID NO: 4593 - protein, 62 aa, Streptococcus pneumoniae
  misc_feature (B) LOCATION 1...62
  hypothetical: YES
PVLFIIPQNNKHKADSKIKIKVHILIFFIDFLSSVLGSLSFSKNFIFNLLSKISTIKKPTFQ

SEQ ID NO: 4594 - protein, 151 aa, Streptococcus pneumoniae
  misc_feature (B) LOCATION 1...151
  hypothetical: YES
CSYIISKFSTVEVDFMSDCIFCKIIAGEIAASEVYEDEQVLAFLDISQVTLGHTLVVPKEHYRNLLEMNATSASQLFAQVPKVAQKVMKVTKAAGMNIISNCEEVAGQTVFHTHVHLVPRYSADDDLKIDFIAHEPDFDKLAQVAETIKNA

SEQ ID NO: 4595 - protein, 659 aa, Streptococcus pneumoniae
  misc_feature (B) LOCATION 1...659
  hypothetical: YES
EEYMSLQSVNAIRFLGVDAINKSNSGHPGIVMGAAPMAYSLFTKHLRITPEQPNWINRDRFILSAGHGSMLLYALLHLTGYKDVSMDEIKNFRQWGSKTPGHPEVTHTSGVDATSGPLGQGISTAVGFAQAERFLAAKYNKDGFPIFDHYTYVIAGDGDFMEGVSAEAASYAGHQALDKLIVLYDSNDICLDGETKDTFSENVRARYDAYGWHTVLVEDGTDLAAISTAIETAKFSGKPSLIEVKTVIGYGSPNKSGTNAVHGAPLGAEETGATRKFLGWDYDPFEVPEEVYSDFKTNVADRGQEAYDAWASLVSDYKVAYPEVASEIDAIVAGKSPVTITEKDFPVYENGFSQATRNSSQDAINTAAAVLPTFLGGSADLAHSNMTYIKADGLQDKYNPLNRNIQFGVREFAMGTILNGMALHGGLRVYGGTFFVFSDYVKAAIRLSAIQELPVTYVFTHDSIAVGEDGPTHEPVEHLAGLRSMPNLTVIRPADARETQAAWHHALTSTTTPTVIVLTRQNLVVEEGTDFGKVAKGAYVVYDTPGFDTIIIATGSEVNLAIKAAKELVLQGGKVRVVSMPSTELFDAQDATYKEDILPSKTRRRVAIEMAATQSWYKYVGLDGAVIGIDIFGASAPAQTVIDNYGFTVENIVAQVKSL

SEQ ID NO: 4596 - protein, 617 aa, Streptococcus pneumoniae
  misc_feature (B) LOCATION 1...617
  hypothetical: YES
QLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASAPAPKVLAEYGFTVENLVKIVRNLK

SEQ ID NO: 4597 - protein, 107 aa, Streptococcus pneumoniae
  misc_feature (B) LOCATION 1...107
  hypothetical: YES
EVHMNQEELQVAAFEIILHSGNARSEIHEAFAKMREGSFDDAESKLNQSNEIILEAHHAQTKLLQEYASGVEIKIEIIMVHAQDHLMTTMTLLEVAKEMLALYKKVN

SEQ ID NO: 4598 - protein, 112 aa, Streptococcus pneumoniae
  misc_feature (B) LOCATION 1...112
  hypothetical: YES
TCHIEILPFHFIRSTDFDLSLSFVKKFFSFTLNDLYSMKIKEQTRKLTADCSKHCFEPVDKTDEVSSKHCFEVVDRTDEVSNHTYGKVKLTWFEEIFEEYYLIKFVNIMSLL

SEQ ID NO: 4599 - protein, 360 aa, Streptococcus pneumoniae
  misc_feature (B) LOCATION 1...360
  hypothetical: YES
NSHMKRIQLNMNETKKYLVIKAIAQGKKTKKRACVELNLSERQINRLLLAYQQKEKEAFRHGNRNRKPKHAIPDEIKERILKKYLSYQTYKPNVRHFCELLAEEEGIQLSDTTVRKILYKKNILSPKSHRKTKKRVRKQAKLNPKQPLDNPILPTAENFLEDPKKVHPSRPRKKFAGELIQMDASPHAWFGVETSNLHLAIDDASGNILGAYFDKQETLNAYYHVLEQILANHGIPLQIKTDKRTVFTYQASNSKKMEDDTHTQFGYACHQLGILLETTSIPQAKGRVERLNQTLQSRLPIELERNNIHTLEEANTFLPSYIQTFNEQFGNKTKLSVFEEAPKPSERNLILARLAGESRR

SEQ ID NO: 4600 - protein, 400 aa, Streptococcus pneumoniae
  misc_feature (B) LOCATION 1...400
  hypothetical: YES
FKHMEANMKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLRSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVVVRSVQSNMPANGHLEKYDVITKVDDKEIASSTDLQSALYNHSIGDTIKITYYRNGKEETTSIKLNKSSGDLES

SEQ ID NO: 4601 - protein, 310 aa, Streptococcus pneumoniae
  misc_feature (B) LOCATION 1...310
  hypothetical: YES
PMILTVTMNPSIDISYPLDELKIDTVNRVVDVTKTAGGKGLNVTRVLSEFGDSVLATGLVGGKLGEFLVEHIDDQVKKDFFSIQGETRNCIAILHGDNQTEVLEKGPEVLEQEGQDFLEHFKKLLESVEVVAISGSLPAGLPVDYYASLVELANQAGKLVVLDCSGAALQAVLESPHKPTVIKPNNEELSQLLGREVSEDLEELKEVLQESLFTGIEWIIVSLGANGTFAKHGDTFYKVDIPRIQVVNPVGSGDSTVAGISSGLLHKESDAGLLIKANVLGMLNAQEKMTGHVNMANYQALYDQLIVKEV

SEQ ID NO: 4602 - protein, 329 aa, Streptococcus pneumoniae
  misc_feature (B) LOCATION 1...329
  hypothetical: YES
ETNMFISISAGIVTFLLTLVGIPAFIQFYRKAQITGQQMHEDVKQHQAKAGTPTMGGLVFLITSVLVAFFFALFSSQFSNNVGMILFILVLYGLVGFLDDFLKVFRKINEGLNPKQKLALQLLGGVIFYLFYERGGDMLSVFGYQVHLGIFYIVFALFWLVGFSNAVNLTDGVDGLASISVVISLSAYGVIAYVQGQMDILLVILAMIGGLLSFFIFNHKPAKIFMGDVGSLALGGMLAAISMALHQEWTLLIIGIVYVFETTSVMMQVSYFKLTGGKRIFRMTPVHHHFELGGLSGKGNPWSEWKVDFFFWGVGLLASLLTLAILYLM

SEQ ID NO: 4603 - protein, 329 aa, Streptococcus pneumoniae
  misc_feature (B) LOCATION 1...329
  hypothetical: YES
RNNMMKSLEGVIDMSSKANHAKTAICGIINVTPDSFSDGGQFFALEQALQQARKLIAEGASMLDIGGESTRPGSSYVEVEIEEEIQRVVPVIKAIRKESDVLISIDTWKSQVAEAALAAGANLVNDITGLMGDEKMAHVIAKDGAKVVIMFNLVMARPQHPSSLIFPHFGFNQAFTEEELADFETLPIEELMETFFERALARANQAGIAQENILLDPGIGFGLTKKENLLLLRDLDKLHQKGYPIFLGVSRKRFVINILEENGFEVNPETELGFHNWDTASAHVTSIAARQGVEVVRVHDVASHKMAVEIASAIRLADEAENLDLKQYK

SEQ ID NO: 4604 - protein, 690 aa, Streptococcus pneumoniae
  misc_feature (B) LOCATION 1...690
  hypothetical: YES
VNNMSFKVLHKGYQHIRLSSSFSLTLDIQNYLRSLARDEKGIESIQFYMDQQHFTLRIKEGFSVLDNAEAFLKRIDKGKVSELMTLPIRREESAYSIVSGAAVKRVLFRSFVPYPIRYIWTSYQALGYIREAYQTIARKELTMEVLDCSAILLSLFMNQSKTASNIMFMLDLGNHLDQWSLKKTATDLEQSLLAKESDVFLVQGDTVVSIKSSDVQIGDVLILSQGNEILFDGQVVSGLGMVNESSLTGESFPVEKRESDLVCANTVLETGELRIRVTDNQMNSRILQLIELMKKSEENKKTKQRYFIKMADKVVKYNFLGAGLTYLLTGSFSKAISFLLVDFSCALKISTPVAYLTVIKEGLNREMVIKDGDVLEKYLEVDTFLFDKTGTITTSYPIVEKVLPFGDYSEEDILRISACLEEHIYHPIANAIVKQAEIEGIEHEEMHGKLQYIASKGIKSHIDGQPVLIGNYVLMQDEQIHISSEQNALIEEYKSHYNLLFLAYQNELIGMFCIHTPLRKEAKTALDKLKAQGKKLILATGDTLIRTEELVKDLPFDQVYTDLKPDGKFELVEKLQKAGHTILMVGDGLNDSAALTLSDIGVVMNESADISKQMSDILLLDNRLDFFQELDSLSSSLQTLIKKNIQDTVVVNSSLIGFGLFNWFSPSNLSILHNLTTLRIVLRSLSIKNR

SEQ ID NO: 4605 - protein, 355 aa, Streptococcus pneumoniae
  misc_feature (B) LOCATION 1...355
  hypothetical: YES
KNNMKKIVFTGGGTVGHVTLNLLLMPKFIEDGWEVHYIGDKRGIEHQEILKSGLDVTFHSIATGKLRRYFSWQNMLDVFKVGWGIVQSLFIMLRLRPQTLFSKGGFVSVPPVIAARVSGVPVFIHESDLSMGLANKIAYKFATKMYSTFEQASSLSKVEHVGAVTKVSDQKNPEPDELVDIQSHFNHKLPTVLFVGGSAGARVFNQLVTDHKKELTERYNIINLTGDSSLNELSQNLFRVDYVTDLYQPLMELADIVVTRGGANTIFELLAIAKLHVIVPLGREASRGDQIENAAYFVKKGYAEDLQESDLTLDSLEEKLSHLLSHKEDYQAKMKASKELKSLADFYQLLKKDLS

SEQ ID NO: 4606 - protein, 79 aa, Streptococcus pneumoniae
  misc_feature (B) LOCATION 1...79
  hypothetical: YES
GDNMLGSMFVGLLVGFLAGAMTNRGERMGCFGKMFLGWIGAFLGHLLFGTWGPVLSGTAIIPAVLGAMIVLAIFWRRGS

SEQ ID NO: 4607 - protein, 286 aa, Streptococcus pneumoniae
  misc_feature (B) LOCATION 1...286
  hypothetical: YES
GMILSKNREDGLRKFATNIRLNTLRTLNHLGFGHYGGSLSIVEVLAVLYGEIMPMTPEIFAARDRDYFILSKGHGGPALYSTLYLNGFFDKEFLYSLNTNGTKLPSHPDRNLTPGIDMTTGSLGQGISVATGLAYGQRIRKSPFYTYAIVGDGELNEGQCWEAIQFASHQQLSNLIVFVDDNKKQLDGFTKDICNPGDFVEKFSAFGFESIRVKGSDIREIYEGIVQLKQSHNSSPKCIVLDTIKGQGVQELEEMKSNHHLRPTVEERQMLTSVVERLSQELEETE

SEQ ID NO: 4608 - protein, 86 aa, Streptococcus pneumoniae
  misc_feature (B) LOCATION 1...86
  hypothetical: YES
LVNMEVRTLANIKSAIKRAELNVKQNEKNSAQKSAMRTAIKAFEANPSEELFRAASSAIDKAETKGLIHKNKASRDKARLSAKLAK

SEQ ID NO: 4609 - protein, 472 aa, Streptococcus pneumoniae
  misc_feature (B) LOCATION 1...472
  hypothetical: YES
VVNMKLNKKIYFFDKGIFNPYRMSNVKLKVNQAVKDKEIFFTEEKPWEIRFDNSYPNVFFDDLAGVYRCYYSTFTDDEESEKYSLEERKERQYLPRAKRIVSLCYAESKDGVNWVKPNLGITEFRGSTENNIIGHFLHGTSVFLDKHDADENRRYKMFTKIDYGNGVHFIAVAFSKDGLHFDEYIKVPNFNPRADTHNHIIYDEALNRYVLITRTWRDSLRLPCVSTSADFINWTPIQEILNVCDYENQIYSMPIFKRGDYILGLASVFHEGDQLNKNYDTVDLQLTYSYRHVGWHYLNTDTPLIPRGKGQYGDGEFDCGCIYSSAPVTIGDRTYFYYMGGNGQHTNFRETSLSRAYIEKDHFAYWDTKRPEYPGVLYTNGFIFLNDQVYLDADIAAGGFVTIELFENNHTPMEITASLEKIEDGRYQVLFSEPLPRTQTRLKISFKNAKIYAIEGNLDIFRIESDNALLRG

SEQ ID NO: 4610 - protein, 79 aa, Streptococcus pneumoniae
  misc_feature (B) LOCATION 1...79
  hypothetical: YES
KANMIQFYLKKNKKGDFIMTLKTLALISGIVGLVGGILLLIGPFVLLGTTVNTAATTLNGGATAGAFSGVACTLECLED

SEQ ID NO: 4611 - protein, 194 aa, Streptococcus pneumoniae
  misc_feature (B) LOCATION 1...194
  hypothetical: YES
RKNMDLKFEGVDLEYKKAKNNLPESFWETYSAFANTNGGKIILGIDEKNIDTYQRVNRLPAKQNYEASKQLTDARFKRLVGVQRTTFEEMLAVLKTAYQLKHAKGGRKPKLSLEDLLMATLQYVREYRTYEEIAADFGIHESNLIRRSQWVEVTLVQSGVTISRTLLSSEDTVMIDATEVKINRPKKTISESFW

SEQ ID NO: 4612 - protein, 787 aa, Streptococcus pneumoniae
  misc_feature (B) LOCATION 1...787
  hypothetical: YES
KENMKDRIKEYLQDKGKVTVNDLAQALGKDSSKDFRELIKTLSLMERKHQIRFEEDGSLTLEIKKKHEITLKGIFHAHKNGFGFVSLEGEEDDLFVGKNDVNYAIDGDTVEVVIKKVADRNKGTAAEAKIIDILEHSLTTVVGQIVLDQEKPKYAGYIRSKNQKISQPIYVKKPALKLEGTEVLKVFIDKYPSKKHDFFVASVLDVVGHSTDVGIDVLEVLESMDIVSEFPEAVVKEAESVPDAPSQKDMEGRLDLRDEITFTIDGADAKDLDDAVHIKALKNGNLELGVHIADVSYYVTEGSALDKEALNRATSVYVTDRVVPMLPERLSNGICSLNPQVDRLTQSAIMEIDKHGRVVNYTITQTVIKTSFRMTYSDVNDILAGDEEKRKEYHKIVSSIELMAKLHETLENMRVKRGALNFDTNEAKILVDKQGKPVDIVLRQRGIAERMIESFMLMANETVAEHFSKLDLPFIYRIHEEPKAEKVQKFIDYASSFGLRIYGTASEISQEALQDIMRAVEGEPYADVLSMMLLRSMQQACYSEHNHGHYGLAADYYTHFTSPIRRYPDLLVHRMIRDYGRSKEIAEHFEQVIPEIATQSSNRERRAIEAEREVEAMKKAEYMEEYVGEEYDAVVSSIVKFGLFVELPNTVEGLIHITNLPEFYHFNERDLTLRGEKSGITFRVGQQIRIRVERADKMTGEIDFSFVPSEFDVIEKGLKQSSRSGRGRGSNRRSDKKEDKRKSGRSNDKRKHSQKDKKKKGKKSFYKEVAKKGAKHGKGRGKGRRTK

SEQ ID NO: 4613 - protein, 157 aa, Streptococcus pneumoniae
  misc_feature (B) LOCATION 1...157
  hypothetical: YES
GENMPQLATICYIDNGKELLMLHRNKKPNDVHEGKWIGVGGKLERGETPQECAAREILEETGLKAKPVLKGVITFPEFTPDLDWYTYVFKVTEFEGDLIDCNEGMLEWVPYDEVLSKPTWEGDHTFVEWLLEDKPFFSAKFVYDGDKLLDTQVDFYE

SEQ ID NO: 4614 - protein, 281 aa, Streptococcus pneumoniae
  misc_feature (B) LOCATION 1...281
  hypothetical: YES
GGNIVGIRVYKPTTNGRRNMTSLDFAEITTSTPEKSLLVALKSKAGRNNNGRITVRHQGGGHKRFYRLVDFKRNKDNVEAVVKTIEYDPNRSANIALVHYTDGVKAYIIAPKGLEVGQRIVSGPEADIKVGNALPLANIPVGTLIHNIELKPGRGGELVRAAGASAQVLGSEGKYVLVRLQSGEVRMILGTCRATVGVVGNEQHGLVNLGKAGRSRWKGIRPTVRGSVMNPNDHPHGGGEGKAPVGRKAPSTPWGKPALGLKTRNKKAKSDKLIVRRRNEK

SEQ ID NO: 4615 - protein, 621 aa, Streptococcus pneumoniae
  misc_feature (B) LOCATION 1...621
  hypothetical: YES
ILNIIEEIMTKLREDIRNIAIIAHVDHGKTTLVDELLKQSETLDARTELAERAMDSNDIEKERGITILAKNTAVAYNGTRINIMDTPGHADFGGEVERIMKMVDGVVLVVDAYEGTMPQTRFVLKKALEQDLVPIVVVNKIDKPSARPAEVVDEVLELFIELGADDDQLDFPVVYASAINGTSSLSDDPADQEATMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDAVEALPILHIDEPTLQMTFLVNNSPFAGKEGKWVTSRKVEERLQAELQTDVSLRVDPTDSPDKWTVSGRGELHLSILIETMRREGYELQVSRPEVIVKEIDGVKCEPFERVQIDTPEEYQGSVIQSLSERKGEMLDMISTGNGQTRLVFLVPARGLIGYSTEFLSMTRGYGIMNHTFDQYLPLIPGEIGGRHRGALVSIDAGKATTYSIMSIEERGTIFVNPGTEVYEGMIIGENSRENDLTVNITKAKQMTNVRSATKDQTAVIKTPRILTLEESLEFLNDDEYMEVTPESIRLRKQILNKAEREKANKKKKSAE

SEQ ID NO: 4616 - protein, 118 aa, Streptococcus pneumoniae
  misc_feature (B) LOCATION 1...118
  hypothetical: YES
RVNIKSASDLLGISADTIRYYERVGLVPPITRTATGIRDFQDQDIEALEFIKCFRSAGVSVDSLVDYMSLYQKGDETREERLGILEEEKQKLEERLSQLQTALNRLNLKIKLYKEGKF

SEQ ID NO: 4617 - protein, 352 aa, Streptococcus pneumoniae
  misc_feature (B) LOCATION 1...352
  hypothetical: YES
GKNMTEYKNIIVTGGAGFIGSNFVHYVYENFPDVHVTVLDKLTYAGNRANIEEILGNRVELVVGDIADAELVDKLAAQADAIVHYAAESHNDNSLNDPSPFIHTNFIGTYTLLEAARKYDIRFHHVSTDEVYGDLPLREDLPGHGEGPGEKFTAETKYNPSSPYSSTKAASDLIVKAWVRSFGVKATISNCSNNYGPYQHIEKFIPRQITNILSGIKPKLYGEGKNVRDWIHTNDHSSGVWTILTKGQIGETYLIGADGEKNNKEVLELILKEMGQAADAYDHVTDRAGHDLRYAIDASKLRDELGWKPEFTNFEAGLKATIKWYTDNQEWWKAEKEAVEANYAKTQEIITV

SEQ ID NO: 4618 - protein, 320 aa, Streptococcus pneumoniae
  misc_feature (B) LOCATION 1...320
  hypothetical: YES
DRNMDFEKIEQAYTYLLENVQVIQSDLATNFYDALVEQNSIYLDGETELEQVKDNNQTLKRLALRKEEWLKTYQFLLMKAGQTEPLQANHQFTPDAIALLLVFIVEELFTEEEITILEMGSGMGILGATFLTSLDKKVDYLGMEVDDLLIDLAASMADVIGLQAGFVQGDAVRPQMLKESDVVISDLPVGYYPDDAVASRHQVASSQEHTYAHHLLMEQGFKYLKSDGYAIFLAPSDLLTSPQSDLLKVWLKEEASLVAMISLPENLFANAKQSKTIFILQKKNEIAVEPFVYPLASLQDASVLMKFKENFQKWTQGTEI

SEQ ID NO: 4619 - protein, 621 aa, Streptococcus pneumoniae
  misc_feature (B) LOCATION 1...621
  hypothetical: YES
SRNIMKQSKMPIPTLREMPSDAQVISHALMLRAGYVRQVSAGVYSYLPLANRVIEKAKNIMRQEFEKIGAVEMLAPALLSAELWRESGRYETYGEDLYKLKNREKSDFILGPTHEETFTAIVRDSVKSYKQLPLNLYQIQPKYRDEKRPRNGLLRTREFIMKDAYSFHANYDSLDSVYDEYKAAYERIFTRSGLDFKAIIGDGGAMGGKDSQEFMAITSARTDLDRWVVLDKSVASFDEIPAEVQEEIKAELLKWIVSGEDTIAYSSESSYAANLEMATNEYKPSNRVVAEEEVTRVATPDVKSIDEVAAFLNVPEEQTIKTLFYIADGELVAALLVGNDQLNEVKLKNHLGADFFDVASEEEVANVVQAGFGSLGPVGLPENIKIIADRKVQDVRNAVVGANEDGYHLXGVNPGRDFTAEYVDIREVREGEISPDGQGVLNFARGIEIGHIFKLGTRYSASMGADVLDENGRAVPIIMGCYGIGVSRLLSAVMEQHARLFVNKTPKGEYRYAWGINFPKELAPFDVHLITVNVKDEEAQALTEKLEASLMGAGYEVLTDDRNERVGVKFSDSDLIGLPIRITVGKKAADGIVEVKIKATGDTIEVHADNVLETLEILSKK

SEQ ID NO: 4620 - protein, 394 aa, Streptococcus pneumoniae
  misc_feature (B) LOCATION 1...394
  hypothetical: YES
KFDIMVVMNRIRVSKRVEKKLAKGLVLLEASDLENVNLKDQEVEVQGQEGNFLGTAYLSQQNKGLGWFVSKDKVAFNQAFFETLFRKAKEKRNAYYQDDLTTAFRLFNQEGDGFGGLTVDLYGDYAVFSWYNSYVYQIRQTISEAFRQVFPEVLGAYEKIRFKGLDYESAHVYGQEAPDFFTVLENGVLYQVFMNDGLMTGIFLDQHEVRGSLVDGLAMGKSLLNMFSYTAAFSVAAAMGGASQTTSVDLAKRSRELSQAHFQANGLSTDEHHFIVMDVFEYFKYAKRKDLTYDVIVLDPPSFARNKKQTFSVAKDYHKLISQSLEILNPGGIIIASTNAANVSRQKFTEQIDKGFAGRSYQILNKYGLPADFAYNKKDESSNYLKVISMKVSK

SEQ ID NO: 4621 - protein, 275 aa, Streptococcus pneumoniae
  misc_feature (B) LOCATION 1...275
  hypothetical: YES
TFDIDIADLRAPLDAEEMSRITIEDEYTLIIVDVPVTEERNNRTYYVTIPLGIIITEETIITTCLEPLPVLDVFINRRLRNFYTFMRSRFIFQILYRNAELYLTALRSIDRKSEQIESQLHQSTRNEELIELMELEKTIVYFKASLKTNERVIKKLTSSTSNIKKYLEDEDLLEDTLIETQQAIEMADIYGNVLHSMTETFASIISNNQNNIMKTLALVTIVMSIPTMVFSAYGMNFKDNEIPLNGEPNAFWLIVFIAFAMSVSLTLYLIHKKWF

SEQ ID NO: 4622 - protein, 198 aa, Streptococcus pneumoniae
  misc_feature (B) LOCATION 1...198
  hypothetical: YES
TKDMKHDFNHKAETFDSPKNIFLANLVCQAVEKQIDILSDKVILDFGGGTGLLALPLAKQAKSVTLVDISEKMLEQARLKVEQQAIKNIQFLEQDLPKNPLEKEFDCLAVSRVLHHMPDLDAALSLFHQHLKEDGKLIIADFTKTEANHHGFDLAELENKLIEHGFSSVHSQILYSAEDLFQGNHSEFFLIVAQKSLA

SEQ ID NO: 4623 - protein, 80 aa, Streptococcus pneumoniae
  misc_feature (B) LOCATION 1...80
  hypothetical: YES
NMDIKSEVIEIIDELFMEDVSDMMDEDLFDAGVLDSMGTVELIVEIENRFDIRVPVTEFGRDDWNTANKIIAGIVELQNA

SEQ ID NO: 4624 - protein, 243 aa, Streptococcus pneumoniae
  misc_feature (B) LOCATION 1...243
  hypothetical: YES
IMDIKLKDFEGPLDLLLHLVSKYQMDIYDVPITEVIEQYLAYVSTLQAMRLEVTGEYMVMASQLMLIKSRKLLPKVAEVTDLGDDLEQDLLSQIEEYRKFKLLGEHLEAKHQERAQYYSKAPTELIYEDAELVHDKTTIDLFLAFSNILAKKKEEFAQNHTTILRDEYKIEDMMIIVKESLIGRDQLRLQDLFKEAQNVQEVITLFLATLELIKTQELILVQEESFGDIYLMEKKEESQVPQS

SEQ ID NO: 4625 - protein, 315 aa, Streptococcus pneumoniae
  misc_feature (B) LOCATION 1...315
  hypothetical: YES
KMDIVYATDNNFVDVLSASIKSLYTTNSDLDLNLWIIADKVSDRNKEKINRLSKQFAQREINWIENVEIPFKLHLDRGSISSFSRLFLGSVLPSSMSKVLYLDSDIIVMDSLRSILDIDFKDKILYGVNDTFNKEYKQVLGIPIDKPMFNAGVMLINLELWRNNNVEEKFLQVIQKFNGTILQGDLGVLNAVLYNSFGVLPPEYNYMTIFEDLTYEEMIVFKKPINYYSKEEIKNARERIVLRHFTTCFLSLRPWQENSEVAHVEIFKKYYRGTYKQVSPSKLSRIYKILPKKMSLYLLGFIQSKVRPKLYRILK

SEQ ID NO: 4626 - protein, 212 aa, Streptococcus pneumoniae
  misc_feature (B) LOCATION 1...212
  hypothetical: YES
TLCIFRKCVNLKEQIFLMGGNPPMKKYSIVDKIVLSTKIKRIIIFTVFRENWEPYMKKYTEVFQSQFPNLNIDYLLLDTEQIDLDSYLDADIIIIGGGNTEKYIATYVNQEFKSYIDHMLNKEAKIIGFSAGALLLGEKVYVSPNDNSDHQIKIKNGLGLFSQFLISVHYDSWNDKANKDRAEELVNVPIIPLNDHSCLVLDKLGNIIEKID

SEQ ID NO: 4627 - protein, 570 aa, Streptococcus pneumoniae
  misc_feature (B) LOCATION 1...570
  hypothetical: YES
LLCIHSSKNTLIKELWLVHLKDKKRKNKRSFLMKFKTFSKSAVLLTASLAVLAACGSKNTASSPDYKLEGVTFPLQEKKTLKFMTASSPLSPKDPNEKLILQRLEKETGVHIDWTNYQSDFAEKRNLDISSGDLPDAIHNDGASDVDLMNWAKKGVIIPVEDLIDKYMPNLKKILDEKPEYKALMTAPDGHIYSFPWIEELGDGKESIHSVNDMAWINKDWLKKLGLEMPKTTDDLIKVLEAFKNGDPNGNGEADEIPFTFISGNGNEDFKFLFAAFGIGDNDDHLVVGNDGKVDFTADNDNYKEGVKFIRQLQEKGLIDKEAFEHDWNSYIAKGHDQKFGVYFTWDKNNVTGSNESYDVLPVLAGPSGQKHVARTNGMGFARDKMVITSVNKNLELTAKWIDAQYAPLQSVQNNWGTYGDDKQQNIFELDQASNSLKHLPLNGTAPAELRQKTEVGGPLAILDSYYGKVTTMPDDAKWRLDLIKEYYVPYMSNDNNYPRVFMTQEDLDKIAHIEADMNDYIYRKRAEWIVNGNIDTEWDDYKKELEKYGLSDYLAIKQKYYDQYQANKN

SEQ ID NO: 4628 - protein, 755 aa, Streptococcus pneumoniae
  misc_feature (B) LOCATION 1...755
  hypothetical: YES
GRCMLCQNCKINDSTIHLYTNLNGKQKQIDLCQNCYKIIKTDPNNSLFKGMTDLNNRDFDPFGDFFNDLNNFRPSSNTPPIPPTQSGGGYGGNGGYGSQNRGSAQTPPPSQEKGLLKEFGINVTEIARRGDIDPVIGRDDEIIRVIEILNRRTKNNPVLIGEPGVGKTAVVEGLAQKIVDGDVPHKLQGKQVIRLDVVSLVQGTGIRGQFEERMQKLMEEIRKREDIILFIDEIHEIVGAGSASDGNMDAGNILKPALARGELQLVGATTLNEYRIIEKDAALERRMQPVKVDEPTVDETITILKGIQKKYEDYHHVQYTDAAIEAAATLSNRYIQDRFLPDKAIDLLDEAGSKMNLTLNFVDPKVIDQRLIEAENLKSQATREEDFEKAAYFRDQIAKYKEMQKKKITDQDTPIISEKTIEHIIEQKTNIPVGDLKEKEQSQLIHLAEDLKSHVIGQDDAVDKIAKAIRRNRVGLGTPNRPIGSFLFVGPTGVGKTELSKQLAIELFGSADSMIRFDMSEYMEKHSVAKLVGAPPGYVGYDEAGQLTEKVRHNPYSLILLDEVEKAHPDVMHMFLQVLDDGRLTDGQGRTVSFKDAIIIMTSNAGTGKTEASVGFGATREGRTNSVLGELGNFFSPEFMNRFDGIIEFKALSKDNLLQIVELMLADVNKRLSSNNIRLDVTDKVKEKLVDLGYDPKMGARPLRRTIQDYIEDTITDYYLENPSEKDLKAVMTSKGNIQIKSAKKAEVKSSEKEK

SEQ ID NO: 4629 - protein, 194 aa, Streptococcus pneumoniae
  misc_feature (B) LOCATION 1...194
  hypothetical: YES
HKCIILYIDKNIDKRKDTNMVLAIILVTFLIRLIFLKRSIENEKRILSNGGKEFGVENTKRLTLAHIVFYLSCLVEAMVHKTMFDGMSMVGLVLLIFSMLMLMLVIHLLGDIWTVKLMLVNNHKYVDHILFRTVKHPNYFLNILPELIGLTLLSHAYMTFVLVFPVYAVILYRRIAEEEKLLHEVIIPNGSIKR

SEQ ID NO: 4630 - protein, 391 aa, Streptococcus pneumoniae
  misc_feature (B) LOCATION 1...391
  hypothetical: YES
GECMRYLTAGESHGPRLTAIIEGIPAGLPLTAEDINEDLRRRQGGYGRGGRMKIESDQVVFTSGVRHGKTTGAPITMDVINKDHQKWLDIMSAEDIEDRLKSKRKITHPRPGHADLVGGIKYRFDDLRNSLERSSARETTMRVAVGAVAKRLLAELDMEIANHVVVFGGKEIDVPENLTVAEIKQRAAQSEVSIVNQEREQEIKDYIDQIKRDGDTIGGVVETVVGGVPVGLGSYVQWDRKLDARLAQAVVSINAFKGVEFGLGFEAGYRKGSQVMDEILWSKEDGYTRRTNNLGGFEGGMTNGQPIVVRGVMKPIPTLYKPLMSVDIETHEPYKATVERSDPTALPAAGMVMEAVVATVLAQEILEKFSSDNLEELKEAVAKHRDYTKNY

SEQ ID NO: 4631 - protein, 491 aa, Streptococcus pneumoniae
  misc_feature (B) LOCATION 1...491
  hypothetical: YES
RRCIVSRKQEQMETLLLLLRDSKDYISAKVLGEKLNCSDKTVYRLVKGINKDCPVEAFILSEKGRGFKLNPRSSLVDVDGNFTEAFDPEVRREKLLERLLLTAPKPHSIYDLGEEFYVSESVVLKDRQILQESLAIYGLDLKMRQRKLFIDGDEAQIRSAILNLLPMFNQLDLEQITQNKVQPLDGELAHFCLGLLITLERELGVNIPYPYNINIFSHLYIFISRNRRSTSIHVVAPSKPTIVDEKIYSVCQKIIQEIEQYFRMKVDAVEIDYLYQYVVSSRLQKPFSSGKLPFSQRVLDVTHYYFSRMCMDNREIETTDPDFVDLASHISPLLRRLDNRVQIKNSLLSQILLTYPNLVKELTTISKEVSLVFGFASLSLDEIGFLVLYFARFQEKRARPLKTVVMCTSGVGTSELLRARLEKQFSELDIIDVVAYHQLDELINLYPDLDFIVTTVALQEPASVPFVLVSVFLTEGDKQRLQAKIQEINYE

SEQ ID NO: 4632 - protein, 217 aa, Streptococcus pneumoniae
  misc_feature (B) LOCATION 1...217
  hypothetical: YES
GQLLCRQKMWPRESRSCRLTKVKICGLSTKEAVETAVSAGADYIGFVFAPSKRQVTLEEAAELAKLIPADVKKVGVFVSPSRVELLEAIDKVDLDLVQVHGQVADDLFENLPCASIQAVQVDGNGHVPNSQADYLLFDAPVAGSGQSFDWGQLDTTGLAQPFFIAGGLNEDNVVKAIQHFTPYAVDVSSGVETDGQKDHEKIRRFIERVKHGISGTK

SEQ ID NO: 4633 - protein, 185 aa, Streptococcus pneumoniae
  misc_feature (B) LOCATION 1...185
  hypothetical: YES
ENSMEIKFTIKQVVAVGIGAALFVVIGMINIPTPVPNTSIQLQYAVQALLSIIFGPIIGLLVGLIGHAIKDSLVGYGLWWTWIISSGLFGLVVGLFRKYVRVINSVFDWKDILIFNLIQLLANALVWGVLAPLGDVVIYQEAAEKVFAQGIVAGIANGVSVAIAGTLLLLAYAGTQTRAGSLKKD

SEQ ID NO: 4634 - protein, 190 aa, Streptococcus pneumoniae
  misc_feature (B) LOCATION 1...190
  hypothetical: YES
GNSMIYLRKLKREDLMSLWEMAYSQLNPVWKQYDAPYYDDYQYFSNFKEFELQKSESILSNSNRLGIFVDDKLVGTVSRYWVCKQTRWMELGIGIYDKKFWNTGIGKVAMLQWIDRTFQDYLELEHLGLTTWSGNLGMMKLAEKLRMKKEAHIPKVRYYQGKYFDSIKYGILREDWEKMNDGYYQINGNS

SEQ ID NO: 4635 - protein, 264 aa, Streptococcus pneumoniae
  misc_feature (B) LOCATION 1...264
  hypothetical: YES
MDSMILGRYIPGDSIVHRLDPRSKLLAMMLLILIVFWANNPLTNLILFIATGIFIALSGVSLSFFIQGLKSMFFLIAFTTIFQLFFISNGNVLFEFSFVRITDYALQQAGIIFCRFVLIIFFSTLLTLTTMPLSLASAVEALLAPLKRVKVPVHEIGLMLSMSLRFVPTLMDDTTRIMNAQKARGVDFGEGSIVQKVKAMIPILIPLFATSLKRADSLAIAMEARGYQGGKGRSQYRQLKWTLKDTLTILVILVLGCCLFFLKS

SEQ ID NO: 4636 - protein, 88 aa, Streptococcus pneumoniae
  misc_feature (B) LOCATION 1...88
  hypothetical: YES
YYSIWEKMMPANTKVIFQEMFADFQNYYVLIGGTATSIVLDSQGFKSRTTKDYDMVIIDEVKNKEFYTTWNHFLELGEYQGSQKDEKA

SEQ ID NO: 4637 - protein, 131 aa, Streptococcus pneumoniae
  misc_feature (B) LOCATION 1...131
  hypothetical: YES
XVSIIATILVLFFNKRLEIIELGEEIAIGLGANPELSRLVLIFCAVSLTAFSTSITGPIACISFLAGPIALNIGKKRSPILAGLVGILLVLLSDIFSQNILPARYPVGVVTALLVSQYLIYLLIKMNRRNI

SEQ ID NO: 4638 - protein, 62 aa, Streptococcus pneumoniae
  misc_feature (B) LOCATION 1...62
  hypothetical: YES
DKSIILNIKSEQNQLSDTQNSVLFAFLSNLSILKIYNKEFLKSKSFYPRLFSFKPNTFYKHF

SEQ ID NO: 4639 - protein, 495 aa, Streptococcus pneumoniae
  misc_feature (B) LOCATION 1...495
  hypothetical: YES
MKSIKLNALSYMGIRVLNIIFPILTGTYVARVLDRTDYGYFNSVDTILSFFLPFATYGVYSYGLRAISNVKDNKKDLNRTFSSLFYLCIACTILTTAVYILAYPLFFTDNPIVKKVYLVMGIQLIAQIFSIEWVNEALENYSFLFYKTAFIRILMLVSIFLFVKNEHDIVVYTLVMSLSTLINYLISYFWIKRDIKLVKIHLSDFKPLFLPLTAMLVFANANMLFTFLDRLFLVKTGIDVNVSYYTIAQRIVTVIAGVVTGAIGVSVPRLSYYLGKGDKEAYVSLVNRGSRIFNFFIIPLSFGLMVLGPNAILLYGSEKYIGGGILTSLFAFRTIILALDTILGSQILFTNGYEKRITVYTVFAGLLNLGLNSLLFFNHIVAPEYYLLTTMLSETSLLVFYIIFIHRKQLIHLGHIFSYTVRYSLFSLSFVAIYFLINFVYPVDMVINLPFLINTGLIVLLSAISYISLLVFTKDSIFYEFLNHVLALKNKFKKS

SEQ ID NO: 4640 - protein, 490 aa, Streptococcus pneumoniae
  misc_feature (B) LOCATION 1...490
  hypothetical: YES
KESMSITSFVKRIQDITRNDAGVNGDAQRIEQMSWLLFLKIYDSREMVWELEEDEYESIIPEELKWRNWAHAQNGERVLTGDELLDFVNNKLFKELKELEITSNMPIRKTIVKSAFEDANNYMKNGVLLRQVINVIDEVDFNSPEDRHSFNDIYEKILKDIQNAGNSGEFYTPRAATDFIAEVLDPKLGESMADLACGTGGFLTSTLNRLSSQRKTSEDTKKYNTAVFGIEKKAFPHLLAVTNLFLHEIDDPKIVHGNTLEKNVREYTDDEKFDIIMMNPPFGGSELETIKNNFPAELRSSETADLFMAVIMYRLKENGRVGVILPDGFLFGEGVKTRLKQKLVDEFNLHTIIRLPHSVFAPYTGIHTNILFFDKTKKTEETWFYRLDMPDGYKNFSKTKPMKSEHFNPVRDWWENREEILEGKFYKSKSFTPSELAELNYNLDQCGFPKEEEEILNPFELIQNYQAERATLNHKIDNVLADILQLLEDK

SEQ ID NO: 4641 - protein, 331 aa, Streptococcus pneumoniae
  misc_feature (B) LOCATION 1...331
  hypothetical: YES
EESIMIQHPRIGIRPTIDGRRQGVRESLEVQTMNMAKSVADLISSTLKYPDGEPVECVISPSTIGRVPEAAASHELFKKSNVCATITVTPCWCYGSETMDMSPDIPHAIWGFNGTERPGAVYLAAVLASHTQKGIPAFGIYGRDVQEANDTAIPEDVKEKLLRYARAALATGLMRDTAYLSMGSVSMGIGGSIVNPDFFQEYLGMRNESVDMTEFTRRMDRGIYDPEEFERALKWVKENVKEGFDHNREDLVLSREEKDRQWEFVIKMFMIGRDLMVGNPRLAELGFEEEAVGHHALVAGFQGQRQWTDHFPNGDFMETFLNTQFDWNGIR

SEQ ID NO: 4642 - protein, 806 aa, Streptococcus pneumoniae
  misc_feature (B) LOCATION 1...806
  hypothetical: YES
YGSMIRNKKQDYVLAYKQPASTTYMGWEEEALPIGNGSLGAKVFGLIGSERIQFNEKSLWSGGPLPDSSDYQGGNLQDQYVFLAEIRQALEKRDYNLAKELAEQHLIGPKTSQYGTYLSFGDIHIEFSQQGTTLSQVTDYQRQLNISKALATTSYVYKGTRFEREAFASFPDDLLVQCFTKEGLETLDFTIELSLTCDLASDGKYEQEKSDYKECKLDITDSHILMKGRVKDNDLRFASYLAWETDGDIRVWSDRVQISGASYANLFLAAKTDFAQNPASNYRKKLDLEQQVIDLVDTAKEKGYTQLKSRHIEDYQALFQRVQLDLEADVDASTTDDLLKNYKPQEGQALEELFFQYGRYLLISSSRDCPDALPANLQGVWNAVDNPPWNSDYHLNVNLQMNYWPAYVTNLLETVFPVINYVDDLRVYGRLAAVKYAGIVSQKGEENGWLVHTQATPFGWTAPGWDYYWGWSPAANAWMMQTVYEAYSFYRDQDYLREKIYPMLRETVRFWNAFLHKDQQAQRWVSSPSYSPEHGPISIGNTYDQSLIWQLFHDFIQAAQELGLDEDLLTEVKEKSDLLNPLQITQSGRIREWYEEEEQYFQNEKVEAQHRHASHLVGLYPGNLFSYKGQEYIEAARASLNDRGDGGTGWSKANKINLWARLGDGNRAHKLLAEQLKTSTLQNLWCSHPPFQIDGNFGATSGMAEMLLQSHAAYLVPLAALPDAWSTGSVSGLMARGHFEVSMSWEDKKLLQLTILSRSGGDLRVSYPDIEKSVIKMNQEKIKAKCMGKDCISVATAEGDLVQFYF

SEQ ID NO: 4643 - protein, 385 aa, Streptococcus pneumoniae
  misc_feature (B) LOCATION 1...385
  hypothetical: YES
VGSIVMKLKFLITNLFHVLLSNLITILTSVIVVLILPKIMGVTEYSYWQLYIFYLTYIGFFHLGWIDGIYLKYGGLEYQNLDKKQFYSQILQFSSFLILISFLLFGFNLLTVTDQNAKYIYNMTIISMIVTNLRMLFVYILQMTNRLKDSSIILISDRVIYVILLFLFIIFKWHEYKVMIWADVLGRTFSLLLSFWICKDIVFQSLSEFILDLRESFDNIRVGINLMLSNIASSMIIGIVRMGIQWNWNIETFGKVSLTLSISNLLMTFINAIGLVVFPLLKRTKTENLSKIYSNLKNVLMLIMFAILLIYYPLKIVLYLWLSAYQDALIFMNLIFPMSVYERKMALVINTYLKGLKMERDILKINTLIMLFSMLVYLNNYSIIK

SEQ ID NO: 4644 - protein, 327 aa, Streptococcus pneumoniae
  misc_feature (B) LOCATION 1...327
  hypothetical: YES
NYGIILAIKEIWRIRIMVSTKTQIAGFEFDNCLMNAAGVACMTIEELEEVKNSAAGTFVTKTATLDFRQGNPEPRYQDVPLGSINSMGLPNNGLDYYLDYLLDLQEKESNRTFFLSLVGMSPEETHTILKKVQESDFRGLTELNLSCPNVPGKPQIAYDFETTDRILAEVFAYFTKPLGIKLPPYFDIVHFDQAAAIFNKYPLKFVNCVNSIGNGLYIEDESVVIRPKNGFGGIGGEYIKPTALANVHAFYQRLNPQIQIIGTGGVLTGRDAFEHILCGASMVQVGTTLHKEGVSAFDRITNELKAIMVEKGYESLEDFRGKLRYID

SEQ ID NO: 4645 - protein, 87 aa, Streptococcus pneumoniae
  misc_feature (B) LOCATION 1...87
  hypothetical: YES
IYGIHVAKIAGLPADLLARADKILTQLENQGTESPPPMRQTSAVTEQISLFDRAEEHPILAELAKLDVYNMTPMQVMNVLVELKQKL

SEQ ID NO: 4646 - protein, 79 aa, Streptococcus pneumoniae
  misc_feature (B) LOCATION 1...79
  hypothetical: YES
IIGIFIGNRIHGFMDFHTSSNLKECTNTLRKSLQTASTLSATSKQCFEQPAASFLVCSLIFIEYKLSIAQLGRIGKDLK

SEQ ID NO: 4647 - protein, 92 aa, Streptococcus pneumoniae
  misc_feature (B) LOCATION 1...92
  hypothetical: YES
DRGMNLKVKQKIPLKIKRMGINGEGIGFYQKTLVFVPGALKGEDIYCQITSIRRNFVEAKLLKVNKKSKFRIVPSCTIYNECGGCANHAPAL

SEQ ID NO: 4648 - protein, 627 aa, Streptococcus pneumoniae
  misc_feature (B) LOCATION 1...627
  hypothetical: YES
GTIFPYFFCYNGTMNNLIKSKLELLPTSPGCYIHKDKNGTIIYVGKAKNLRNRVRSYFRGSHNTKTEALVSEIVDFEFIVTESNIEALLLEINLIKENKPKYNIMLKDDKSYPFIKITNERYPRLIITRQVKKDGGLYFGPYPDVGAANEIKRLLDRIFPFRKCTNPPSKVCFYYHIGQCMAHTICKKDEAYFKSMAQEVSDFLKGQDDKIIDDLKSKMAVAAQSMEFERAAEYRDLIQAIGTLRTKQRVMAKDLQNRDVFGYYVDKGWMCVQVFFVRQGKLIERDVNLFPYFNDPDEDFLTYVGQFYQEKSHLVPNEVLIPQDIDEEAVKALVDSKILKPQRGEKKQLVNLAIKNARVSLEQKFNLLEKSVEKTQGAIENLGRLLQIPTPVRIESFDNSNIMGTSPVSAMVVFVNGKPSKKDYRKYKIKTVVGPDDYASMREVIRRRYGRVQREALTPPDLIVIDGGQGQVNIAKQVIQEELGLDIPIAGLQKNDKHQTHELLFGDPLEVVDLSRNSQEFFLLQRIQDEVHRFAITFHRQLRSKNSFSSQLDGIDGLGPKRKQNLMKHFKSLTKIKEASVDEIVEVGVPRVVAEAVQRKLNPQGEALPQVAEERVDYQTEGNHNEP

SEQ ID NO: 4649 - protein, 165 aa, Streptococcus pneumoniae
  misc_feature (B) LOCATION 1...165
  hypothetical: YES
LQIFQGFISQFSIVVGFFYTEIDIPLTLIGKAFLDQVFHKTDDVCHKLHYTRMASRRFHAQCRHILTKGSDVLIRNLLRCDAFFPGTVDNLIIHICKIGNIGNLIPTVLKIATNRIKSYRRTGVSHVNIVVHGWPTNIHLDLAVLNRDKFSQITRHGVIDFNHKS

SEQ ID NO: 4650 - protein, 455 aa, Streptococcus pneumoniae
  misc_feature (B) LOCATION 1...455
  hypothetical: YES
GKILMYQALYRKYRSQNFSQLVGQEVVAKTLKQAVEQEKISHAYLFSGPRGTGKTSVAKIFAKAMNCPNQVGGEPCNNCYICQAVTDGSLEDVIEMDAASNNGVDEIREIRDKSTYAPSLARYKVYIIDEVHMLSTGAFNALLKTLEEPTQNVVFILATTELHKIPATILSRVQRFEFKSIKTQDIKEHIHYILEKENISSEPEAVEIIARRAEGGMRDALSILDQALSLTQGNELTTAISEEITGTISLSALDDYVAALSQQDVPKALSCLNLLFDNGKSMTRFVTDLLHYLRDLLIVQTGGENTHHSSVFVENLALPQKNLFEMIRLATVNLADIKSSLQPKIYAEMMTVRLAEIKPEPALSGAVENEIATLRQEVARLKQELSNAGAVPKQVAPAPSRPATGKTVYRVDRNKVQSILQEAVENPDLTRQNLIRLQNAWGEVIESLGGPDKLC

SEQ ID NO: 4651 - protein, 70 aa, Streptococcus pneumoniae
  misc_feature (B) LOCATION 1...70
  hypothetical: YES
VPFIIPQTSHPDQFVLHFQGWNRQQKEPCFSEKEVSLLSLYSMKIKEQTRKLATGCSKHRFEVADKTDTV

SEQ ID NO: 4652 - protein, 115 aa, Streptococcus pneumoniae
  misc_feature (B) LOCATION 1...115
  hypothetical: YES
SIIIVINIEEENIMVKIGLFCAAGFSTGMLVNNMKIAAQASGVEAEIEAFSQSKLADYAPNIDVALLGPQVAYTLDKSKEICDKCDVPIAVIPMMDYGMLDGKKVLDLALSLISG

SEQ ID NO: 4653 - protein, 237 aa, Streptococcus pneumoniae
  misc_feature (B) LOCATION 1...237
  hypothetical: YES
AVIMPNHEGLDLQLPKKCVYALVGEEIDRYAREVGADCVGEFVSATKTYPVYVINYKGEEVCLAQAPVGSAPAAQFMDWLIGYGVEQIISTGTCGVLADIEENAFLVPVRALRDEGASYHYVAPCRYMEMQPEAIAAIEEVLEDRGIPYEEVMTWTTDGFYRETAEKVAYRKEEGCAVVEMECSALAAVAQLRGVLWGELLFTADSLADLDQYDSRDWGSEAFNKALELSLASVHHL

SEQ ID NO: 4654 - protein, 184 aa, Streptococcus pneumoniae
  misc_feature (B) LOCATION 1...184
  hypothetical: YES
EPIMEFEEKTLSRKEIYQGPIFKLVQDQVELPEGKGTARRDLIFHNGAVCVLAVTDEQKLILVKQYRKAIEAVSYEIPAGKLEVGENTAPVAAALRELEEETAYTGKLELLYDFYSAIGFCNEKLKLYLASDLTKVENPRPQDEDETLEVLEVSLEEAKELIQSGHICDAKTIMAVQYWELQKK

SEQ ID NO: 4655 - protein, 81 aa, Streptococcus pneumoniae
  misc_feature (B) LOCATION 1...81
  hypothetical: YES
GTIICGFFRYFIPKYVSESRVLYLDSDIVVRKSIDELWDLDLTAIPLAAVRDDFYTHNFNSGVLLINDGMWRAENVTQDLI

SEQ ID NO: 4656 - protein, 332 aa, Streptococcus pneumoniae
  misc_feature (B) LOCATION 1...332
  hypothetical: YES
RDIMKYIINHSNDTAFNIALEEYAFKHLLDEDQIFLLWINKPSIIVGRHQNTIEEINRDYVRENGIEVVRRISGGGAVYHDLNNLNYTIISKEDENKAFDFKSFSTPVINTLAQLGVKAEFTGRNDLEIDGKKFCGNAQAYINGRIMHHGCLLFDVDLSVLANALKVSKDKFESKGVKSVRARVTNIINELPKKITVEKFRDLLLEYMKKEYPEMTEYVFSEEELAEINHIKDTKFGTWDWNYGKSPEFNVRRGTKFTSGKVEVFANVTESKIQDIKIYGDFFGIEDVAAVEDVLRGVKYEREDVLKALKTIDITRYFAGISREEIAEAVVG

SEQ ID NO: 4657 - protein, 70 aa, Streptococcus pneumoniae
  misc_feature (B) LOCATION 1...70
  hypothetical: YES
FFIIRIFLISSIGPMTRKARTGAKPKLESREAPIKASASLQSERRKAKIIKSRMAKRGVALIEVRIRVGT

SEQ ID NO: 4658 - protein, 348 aa, Streptococcus pneumoniae
  misc_feature (B) LOCATION 1...348
  hypothetical: YES
EVIMDIRQVTETIAMIEEQNFDIRTITMGISLLDCIDPDINRAAEKIYQKITTKAANLVAVGDEIAAELGIPIVNKRVSVTPISLIGAATDATDYVVLAKALDKAAKEIGVDFIGGFSALVQKGYQKGDEILINSIPRALAETDKVCSSVNIGSTKSGINMTAVADMGPIIKETANLSEIGVAKLVVFANAVEDNPFMAGAFHGVGEADVIINVGVSGPGVVKRALEKVRGQSFDVVAETVKKTAFKITRIGQLVGQMASERLGVEFGIVDLSLAPTPAVGDSVARVLEEMGLETVGTHGTTAALALLNDQVKKGGVMACNQVGGLSGAXIPVSEGEGMIAAVRKWLS

SEQ ID NO: 4659 - protein, 158 aa, Streptococcus pneumoniae
  misc_feature (B) LOCATION 1...158
  hypothetical: YES
FPIIMGSKSDWATMQKTAEVLDRFGVAYEKKVVSAHRTPDLMFKHAEEARSRGIKIIIAGAGGAAHLPGMVAAXTTYPVIGVPVKSRALSGVDSLYSIVQMPGGVPVATMAIGEAGATNAALFAIRLLSVEDKSIADALANFAEEQGKIAEESSNELI

SEQ ID NO: 4660 - protein, 186 aa, Streptococcus pneumoniae
  misc_feature (B) LOCATION 1...186
  hypothetical: YES
GSIMKSIGTQILQTERLILRRFVESDAEAMFQNWASSAENLTYVTWNPHPDVEITRNSIRNWVASYTNLNYYKWAICLKENPEQVIGDISIVKIDEADLSCEIGYVLGKAYWGHGMMTEALKAVLDFCFTQAGFQKVRARYASLNPASGRVMEKAGMSYLQTIVNGVERKGYLADLIYYGISREEC

SEQ ID NO: 4661 - protein, 484 aa, Streptococcus pneumoniae
  misc_feature (B) LOCATION 1...484
  hypothetical: YES
VLIMSRRFKKSGSQKVKRSVNIVLLTIYLLLVCFLLFLIFKYNILAFRYLNLVATAFVLLVALIGLLSIIYKKAEKFTIFLLVLSILVSSVSLFAVQQFVGLTNRLNATSNYSEYSLSVAVLADSEIENVTQLTSVTAPTGTDNENIQKLLADIKSSQNIDLTVNQSSSYLSAYRSLIAGETKAIVLNSVFENIIESEYPDHASKIKKIYTKGFIKKVEAPKTSKNQSFNIYVSGIDTYGPISSVSRSDVNILMTVNRDTKKILLTTTPRDAYVPIADGGNNQKDKLTHAGIYGVDSSIHTLENLYGVDINYYVRLNFTSFLKLIDLLGGVDVYNDQEFTALANKKHYSIGNVHLDSEEALAFVRERYSLADGDRDRGRNQQKVIVAILQKLTSTEVLKNYSTIIDSLQDSIQTNMPLETMINLVNAQLESGGTYKVNSQDLKGRGRTDLPSYAMPDSNLYVMEINDSSLASVKTAIQDVLEGR

SEQ ID NO: 4662 - protein, 255 aa, Streptococcus pneumoniae
  misc_feature (B) LOCATION 1...255
  hypothetical: YES
CRIMEKFEMISITDIQKNPYQPRKEFDREKLDELAQSIKENGVIQPIIVRQSPVIGYEILAGERRYRASLLAGLRSIPAVVKQISDQEMMVQSIIENLQRENLNPIEEARAYESLVEKGFTHAEIADKMGKSRPYISNSIRLLSLPEQILSEVENGKLSQAHARSLVGLNKEQQDYFFQRIIEEDISVRKLEALLTEKKQKKQQKTNHFIQNEEKQLRKLLGLDVEIKLSKKDSGKIIISFSNQEEYSRIINSLK

SEQ ID NO: 4663 - protein, 274 aa, Streptococcus pneumoniae
  misc_feature (B) LOCATION 1...274
  hypothetical: YES
KGIIMDQLQIKDLEMFAYHGLFPSEKELGQKFVVSAILSYDMTKAATDLDLTASVHYGELCQQWTTWFQETSEDLIETVAYKLVERTFESYPLVQEMKLELKKPWAPVHLSLDTCSVTIHRRKQRAFIALGSNMGDKQANLKQAIDKLRARGIYILKESSVLATEPWGGVEQDSFANQVVEVETWLPAQDLLETLLAIESELGRVREVHWGPRLIDLDLLFVEDQILYTDDLILPHPYIAERLFVLESLQEIAPHFIHPILKQPIRNLYDALKK

SEQ ID NO: 4664 - protein, 71 aa, Streptococcus pneumoniae
  misc_feature (B) LOCATION 1...71
  hypothetical: YES
STIIVFFSLLISWFFCFWLFSWLLWFWCGSWLRSRRWFWLFSWCFWGWSFWSWSWFFWLINCFLKVSFSFF

SEQ ID NO: 4665 - protein, 94 aa, Streptococcus pneumoniae
  misc_feature (B) LOCATION 1...94
  hypothetical: YES
SWIILIRITLYCYFRNWGGLMESIGLVIVSHSKHIAEGVVALISKVAKDVPITYVGGTEGGGIGTSFDQVDRVVSENPADTLLAFFDLGSAIKC

SEQ ID NO: 4666 - protein, 338 aa, Streptococcus pneumoniae
  misc_feature (B) LOCATION 1...338
  hypothetical: YES
AGIIALSSFVLMALRFSSMVYDTNGEQVKQLFGGAIPFFSLNASSLFMAITIGLVTAEIYRMFIQRGITIKMPSGVPDVVSKSFSALLPGFTTFVLWALVLKGLEAAGVAGGLNGFLGAIVGTPLKLIAGTLPGMILCVIVNSFFWFCGVNGGQVLNAFVDPVWLQFTTENQEAVAAGQTLQHIITLPFKDLFVFIGGGGATIGLAICLFLFSKSRANKTLGKLAIIPSIFNINTAILFTFPTVLNPIMLIPFIATPTINALITYVSMAVGLVPYTTGVILPWTMPPIIGGFLATGASWRGALLQVVLILVSVAIYYPFFKIADKRNLEKEKATVGGK

SEQ ID NO: 4667 - protein, 240 aa, Streptococcus pneumoniae
  misc_feature (B) LOCATION 1...240
  hypothetical: YES
NTVILNIKEFDMEWIRLIGIAIIVVGFILKFDTIATVVLAGLVTALVSGVSLVEFLEILGKEFSNQRVLTIFMVTLPLVGLSETFGLKQRSIDLIRKIKGLTVGNFYTVYFFIRELAGFFSIRLGGHPQFVRPLVQPMGEAAAESQLGRKLTEVEDETIKARAAANENFGNFFAQNTFVGAGGVLLIGGTLDQLGYESNYAGIASTSIIVAVITLIVVGIYNYLFDKKLISKKTRGGEQK

SEQ ID NO: 4668 - protein, 171 aa, Streptococcus pneumoniae
  misc_feature (B) LOCATION 1...171
  hypothetical: YES
NSVMSKMYYAENPDAAHDIHELRVDLLGQKMTFLTDAGVFSKKIVDFGSQLLLKCLEVNQGETVLDVGCGYGPLGLSLAKAYGVQATMVDINTRALDLARRNAEKNNAKATIFQSNIYEQVEGHFDHVISNPPIRAGKQVVHEIIEKSKDFLETGGDLTIVIQKKTRGSKC

SEQ ID NO: 4669 - protein, 473 aa, Streptococcus pneumoniae
  misc_feature (B) LOCATION 1...473
  hypothetical: YES
GLVMENLQFKALPKEFLLGAATAAYQVEGATRVDGKGINMWDVYLQENSPFLPDPASDFYYRYEEDIALAAEHGLQALRLSISWVRIFPDIDGDANILAVRYYHRVFQSCLKHNVIPFVSLHHFDSPQKMLETGDWLDRENIDHFIRYARFCFQEFTEVKHWFTINELMSLAAGQYIGGQFPPNHHFQLSEAIQANHNMLLAHALAVLEFHQLGIEGEIGCIHALKPGYPIDGQKENILAAKRYDVYNNKFLLDGTFLGYYSEDTLFHLNQILEANNSSFIIEDGDLEIMKRAAPLNTMFGMNYYRSEFIREYKGENRQEFNSTGIKGQSSFKLNALGEFVKKTGIPTTDWDWNIYPQGLFDMLLRIKEEYPQHPVIYLTENGTALKEVKPEGENDIIDDSKRIRYIEQHLHKVLEARDRGVNIQGYFIWSLQDQFSWANGYNKRYGLFFVDYETQKRYIKKSALWVKGLKRN

SEQ ID NO: 4670 - protein, 63 aa, Streptococcus pneumoniae
  misc_feature (B) LOCATION 1...63
  hypothetical: YES
KQVIKTRECSHTLTAKKENVAPRDQEFYDKAYNLLTEAHKASFENKGRNSDSKTLRQIIRTLE

SEQ ID NO: 4671 - protein, 162 aa, Streptococcus pneumoniae
  misc_feature (B) LOCATION 1...162
  hypothetical: YES
NRVMKIKVVTVGKLKEKYLKDGIAEYSKRISRFAKFEMIELSDEKTPDKASESENQKILEIEGQRILSKIADRDFVIVLAIEGKTFFSEEFSKQLEETSIKGFSTLTFIIGGSLGLSSSVKNRANLSVSFGRLTLPHQLMRLVLVEQIYRAFTIQQGFPYHK

SEQ ID NO: 4672 - protein, 287 aa, Streptococcus pneumoniae
  misc_feature (B) LOCATION 1...287
  hypothetical: YES
KLVIGEIFIKLKLSNNSIESKESKNLKKKWFFADYYDTTIILLALISVILVLLGFAEMIDLDNPPYSIIDLVIWGVFVIDYSWRFFTTKRKWRFILENIFDLLAILPLNAIFTVFRLGRIFRLAKLTKLLKLTRLLRIIGLTGKLERKISRFLRTNGLIYILYVNIFIVLVGSSILSVVEEKSFSDSLWWALVTVTTVGYGDIVPASIFGKWLAVLLMLVGIGTIGMLTSALTNFFVKDNPDEQIKLDKLKDELSSQRILLEKQSTKIEELPLMIPDLIDKTLSISR

SEQ ID NO: 4673 - protein, 296 aa, Streptococcus pneumoniae
  misc_feature (B) LOCATION 1...296
  hypothetical: YES
WEVILMTEKLINSKPNGVFALILIELTIVLGVFIFIMGVGSENIFGIIIGPLLIVIAALTHAGLKVVKPQEALVLTLFGNYTGTIKEPGFYFVNPFSVAVNPANHTRLGQSGDVSTKSPFLGAKSSNDNDVNLEIGKKHISLKVMTLSNSRQKINDCLGNPVEIGIAVTWRVVDTAKAVFNVDNYKEYLSLQCDSALRNIVRIYPYDVSPNVDTTGERQANESSLRGSSEIVANRIREKIQSRVEDAGLEILEARITYLPNAPKIAAVMLQRQQTSAIIDARKINVNGAVGMVKMA

SEQ ID NO: 4674 - protein, 145 aa, Streptococcus pneumoniae
  misc_feature (B) LOCATION 1...145
  hypothetical: YES
RRVIIILLGSHQMEILHFKELYKEKRLQLQGQGQNGKGYSQAFLLGLTFSFAWTPCVGPVLGSVLALAASGGSRAWQGAGLMLVYTLGLALPFLLLALTSSYVLKHFRKLHPYLGILKKVGGFLIIVMGLLVLFGNASILSQLFE

SEQ ID NO: 4675 - protein, 446 aa, Streptococcus pneumoniae
  misc_feature (B) LOCATION 1...446
  hypothetical: YES
GDSMKIDITNQVKDEFLISLKTLISYPSVLNEGENGTPFGQAIQDVLEKTLEICRDIGFTTYLDPKGYYGYAEIGQGAELLAILCHLDVVPSGDEADWQTPPFEATIKDGWVFGRGVQDDKGPSLAALYAVKSLLDQGIQFKKRVRFIFGTDEETLWRCMARYNTIEEQASMGFAPDSSFPLTYAEKGLLQVKLHGPGSDQLELEVGGAFNVVPDKANYQGPLYEQVCNDLKEAGYDYQSTEQTVTVLGVPKHAKDASQGINAVIRLATILAPLQEHPALSFLATQAGQDGTGRQIFGDIADEPSGHLSFNVAGLMINHERSEIRIDIRTPVLADKEELVKLLTRCAQNYQLRYEEFDYLAPLYVAKDSKLVSTLMQIYQEKTGDNSPAISSGGATFARTMPNCVAFGALFPGAKQTEHQANECAVLEDLYRAMDIYAEAVYRLAT

SEQ ID NO: 4676 - protein, 71 aa, Streptococcus pneumoniae
  misc_feature (B) LOCATION 1...71
  hypothetical: YES
GCSILCRGPESNRYDRYQSQDFKSCASASSATPASLSERRDSNPRPPPWQGGVLPLNYVRTVFFYLKMPAT

SEQ ID NO: 4677 - protein, 71 aa, Streptococcus pneumoniae; identical to SEQ ID NO: 4676
  misc_feature (B) LOCATION 1...71
  hypothetical: YES

SEQ ID NO: 4678 - protein, 120 aa, Streptococcus pneumoniae
  misc_feature (B) LOCATION 1...120
  hypothetical: YES
DVPMEIPIKIIQASKSDLPEIGALQTSSFPAEKQQLSHILEESIRKCADTFLLARDENQLLGYILSSPQSDNPQCLKVHSLVIESDHQRQGLGTLLLAALKEVAVELDYKGFVWRSCGVF

SEQ ID NO: 4679 - protein, 116 aa, Streptococcus pneumoniae
  misc_feature (B) LOCATION 1...116
  hypothetical: YES
ANPIGTKVLSNPIVIDLLDWYFDQLSPLVSLEFFPQATKNKAVIRLTNTSIHFFIHFFIHFSSYLGSTFNNTSAIFSANCKSWVTTIWVIPSSLFCKISFSTSKRNSGSRAEVGSS

SEQ ID NO: 4680 - protein, 499 aa, Streptococcus pneumoniae
  misc_feature (B) LOCATION 1...499
  hypothetical: YES
EDPMSTEHMEELNDQQIVRREKMAALREQGIDPFGKRFERTANSQELKDKYANLDKEQLHDKNETATIAGRLVTKRGKGKVGFAHLQDREGQIQIYVRKDAVGEENYEIFKKADLGDFLGVEGEVMRTDMGELSIKATHITHLSKALRPLPEKFHGLTDVETIYRKRYLDLISNRESFERFVTRSKIISEIRRYLDQKGFLEVETPVLHNEAGGAAARPFITHHNAQNIDMVLRIATELHLKRLIVGGMERVYEIGRIFRNEGMDATHNPEFTSIEVYQAYADFQDIMDLTEGIIQHAAKSVKGDGPVNYQGTEIKINEPFKRVHMVDAIREITGVDFWQDMTLEEAKAIAAEKKVPVEKHYTEVGHIINAFFEEFVEETLIQPTFVYGHPVAVSPLAKKNPEDQRFTDRFELFIMTKEYGNAFTELNDPIDQLSRFEAQAKAKELGDDEATGIDYDYIEALEYGMPPTGGLGIGIDRLCMLLTDTTTIRDVLLFPTMK

SEQ ID NO: 4681 - protein, 95 aa, Streptococcus pneumoniae
  misc_feature (B) LOCATION 1...95
  hypothetical: YES
VHPIHYHCPENISNFQRNSRIGISFGGGRVMNKYKVIYYVVVIALLVSVFLLIGMDLSWFNPYQSDQFVWVYFALIPVIEWIEKKSKNLASEKGE

SEQ ID NO: 4682 - protein, 197 aa, Streptococcus pneumoniae
  misc_feature (B) LOCATION 1...197
  hypothetical: YES
ENTMSYKDTVQKILDVIGGEKNVNRVTHCVTRLRLELKDENLVNDDDVKKIPGVIGIMKKNGQYQIILGNDVANYYKEFVKLGNFESDSVVQGHKGNILERIIEYIAGSMTPIIPAMLGGGMLKVLVIILPMLGILQSDSQTIAFLTFFGDAPYYFLPLLLAYSASQKLKVTSTIAMSVAGDFSIQILFKWCNQESS

SEQ ID NO: 4683 - protein, 74 aa, Streptococcus pneumoniae
  misc_feature (B) LOCATION 1...74
  hypothetical: YES
RPTILVHVCCAPCSTYTLEYLTKYADVTIYFANSNIHPKAEYHKRVYVTKKFVSDFNERTGNTVQYLEAPYEPN

SEQ ID NO: 4684 - protein, 182 aa, Streptococcus pneumoniae
  misc_feature (B) LOCATION 1...182
  hypothetical: YES
ERTMSLKDRFDRFIDYFTEDEDSSLPYEKRDEPVFTSVNSSQEPALPMNQPSQSAGTKENNITRLHARQQELANQSQRATDKVIIDVRYPRKYEDATEIVDLLAGNESILIDFQYMTEVQARRCLDYLDGACHVLAGNLKKVASTMYLLTPVNVIVNVEDIRLPDEDQQGEFGFDMKRNRVR

SEQ ID NO: 4685 - protein, 63 aa, Streptococcus pneumoniae
  misc_feature (B) LOCATION 1...63
  hypothetical: YES
PGTIGPGLGFGLRPRGSSGFKTKGFRNLEGWRIFNLGKEEGVYFKTTKKGLKSGVPGNFGFFP

SEQ ID NO: 4686 - protein, 360 aa, Streptococcus pneumoniae
  misc_feature (B) LOCATION 1...360
  hypothetical: YES
LLAILKKNFVPSYDVESFVNSIEKPRRIMLMVQAGPGTDATIQALLPHLDKGDILIDGGNTFYKDTIRRNEELANSGINFIGTGVSGGEKGALEGPSIMPGGQKEAYELVSDVLEEISAKAPEDGKPCVTYIGPDGAGHYVKMVHNGIEYGDMQLIAESYDLMQHLLGLSAEDMAEIFTEWNKGELDSYLIEITADILSRKDDEDQDGPIVDYILDAAGNKGTGKWTSQSSLDLGVPLSLITESVFARYISTYKEERVHASKVLPKPAAFNFEGDKAELIEKIRQALYFSKIISYAQGFAQLRVASKENNWNLPFADIASIWRDGCIIPSSFLAKDYRCLQPRCRSCPPSFGRVLLGCYC

SEQ ID NO: 4687 - protein, 113 aa, Streptococcus pneumoniae
  misc_feature (B) LOCATION 1...113
  hypothetical: YES
EAAMLELRNINKVFGDKQILSNFSLSIPEKQILAIVGPSGGGKTTLLRMLAGLETIDSGQIFYNGQPLELDELQKRNLLGFVFQDFQLFPHLSVLENLTLSPVKTHGNEAGRG

SEQ ID NO: 4688 - protein, 82 aa, Streptococcus pneumoniae
  misc_feature (B) LOCATION 1...82
  hypothetical: YES
LSAIISLFFSSLNLFNYSINIDFIQSYIDLVICFREFVVLFRPYFAINCFKWDLLSLPFLPPNFEYKKDDRVFNFYRLRFTY

SEQ ID NO: 4689 - protein, 126 aa, Streptococcus pneumoniae
  misc_feature (B) LOCATION 1...126
  hypothetical: YES
LIVFENLFKPRQRRLTVYMLLTSSVLSATSKPCFELTSSVSSATSKPCFELTSSVSSTTSKPCFELTSSVLSTTSKQCFEQPAASFLVCTLIFIEYKKILGKDSISVEKEVNLPTIKRIVSSFFNT

SEQ ID NO: 4690 - protein, 69 aa, Streptococcus pneumoniae
  misc_feature (B) LOCATION 1...69
  hypothetical: YES
KKVFKIIKRIISSFFKNLDMMRFIVGIFISFSTKIMFLNNLYLSSLYNPPQSAFTISFNTMTIPFLHFF

SEQ ID NO: 4691 - protein, 208 aa, Streptococcus pneumoniae
  misc_feature (B) LOCATION 1...208
  hypothetical: YES
GVYMSQDKQMKAVSPLLQRVINISSIVGGVGSLIFCIWAYQAGILQSKETLSAFIQQAGIWGPPLFIFLQILQTVVPIIPGALTSVAGVFIYGHIIGTIYNYIGIVIGCAIIFYLVRLYGAAFVQSVVSKRTYDKYIGWLDKGNRFDRFFIFMMIWPISPADFLCMLAALTKMSFKRYMTIIILTKPFTLVVYTYGLTYIIDFFWQML

SEQ ID NO: 4692 - protein, 212 aa, Streptococcus pneumoniae
  misc_feature (B) LOCATION 1...212
  hypothetical: YES
ENYMTKSDTIIELKKQKIVAVIRGNTKEEGLQASIACIKGGIKAIEIAYTNQYAGQIIKELVDLYQDDQSVCIGAGTVLDAVTARDAILAGANYVVSPSFHAETAKMCNLYSTPYIPGCITLTEITTALEAGSEIIKLFPGSTLSPAYISAVKAPIPQVSVMVTGGVGLNNIPQWFAAGADAVGIGGELNKLASQGNFDRISEIAQQYITLR

SEQ ID NO: 4693 - protein, 388 aa, Streptococcus pneumoniae
  misc_feature (B) LOCATION 1...388
  hypothetical: YES
FLVFLFALSHYIINLQKQFKRRTIMEVVSSVLNWFSSNILQNPAFFVGLLVLIGYALLKKPAHDVFSGFVKATVGYMLLNVGAGGLVTTFRPILAALNYKFQIGAAVIDPYFGLAAANNKIVAEFPDFVGTATTALLIGFGINILLVALRKITKVRTLFITGHIMVQQAATVSLMVLFLVPQLRNAYGTAAIGIICGLYWAVSSNMTVEATQRLTGGGGFAIGHQQQFAIWFVDKVAGRFGKKEESLDNLKLPKFLSIFHDTVVASATLMLVFFGAILLILGPDIMSNKEVITSGTLFNPAKQDFFMYIIQTAFTFSVYLFVLMQGVRMFVSELTNAFQGISNKLLPGSFPAVDVAASYGFGSPNAVLSGFTFGFDWSIDYNCFAHRL

SEQ ID NO: 4694 - protein, 210 aa, Streptococcus pneumoniae
  misc_feature (B) LOCATION 1...210
  hypothetical: YES
IMVLSKKRARKVLEEIIALFPDAKPSLDFTNHFELLVAVMLSAQTTDAAVNKATPGLFVAFPTPQAMSVATESEIASHISRLGLYRNKAKFLKKCAQQLLDDFDGQVPQTREELESLAGVGRKTANVVMSVGFGIPAFAVDTHVERICKHHDIVKKSATPLEVEKRVMDILPPEQWLDAHQAMIYFGRAICHPKNPECDQYPQLYDFSNL

SEQ ID NO: 4695 - protein, 117 aa, Streptococcus pneumoniae
  misc_feature (B) LOCATION 1...117
  hypothetical: YES
GEHMIQAVFERAEDGELRSAEITGHAESGEYGLDVVCASVSTLAINFINSIEKFAGYEPILELNEDEGGYLMVEIPKDLPSHQREMTQLFFESFFLGMANLSENSSEFVQTRVITEN

SEQ ID NO: 4696 - protein, 123 aa, Streptococcus pneumoniae
  misc_feature (B) LOCATION 1...123
  hypothetical: YES
KVNIPNSESTKPKTFEIDCLVGEKHAYEIKWWDATTDGDHITKEHTRIKVIHNKGYIPIRLMFYYPNRTQAIKIQQTLETLYNGIGGKYYGDSAWEHLRAVTGIDLLSILTDIANKKTGVKSK

SEQ ID NO: 4697 - protein, 71 aa, Streptococcus pneumoniae
  misc_feature (B) LOCATION 1...71
  hypothetical: YES
VCNMQLKNRLKELRAREWSQSNRPSQTGRGFRQTISLLERDEYTPSIIIALKISQIFNETVESVFRLEEDE

SEQ ID NO: 4698 - protein, 540 aa, Streptococcus pneumoniae
  misc_feature (B) LOCATION 1...540
  hypothetical: YES
GKNMEIMSLAIAVFAVIIGLVIGYVSISAKMKSSQEAAELMLLNAEQEATNLRGQAEREADLLVNEAKRESKSLKKEALLEAKEEARKYREEVDAEFKSERQELKQIESRLTERATSLDRKDDNLTSKEQTLEQKEQSISDRAKNLDAREEQLEEVERQKEAELERIGALSQAEARDIILAQTEENLTREIASRIREAEQEVKERSDKMAKDILVQAMQRIAGEYVAESTNSTVHLPDDTMKGRIIGREGRNIRTFESLTGVDVIIDDTPEVVTLSGFDPIRREIARMTMEMLLKDGRIHPARIEELVEKNRQEIDNKIREYGEAAAYEIGAPNLHPDLMKIMGRLQFRTSYGQNVLRHSIEVAKLAGIMASELGENAALARRAGFLHDIGKAIDHEVEGSHVEIGMELARKYKEPPVVVNTIASHHGDVEAESVIAVIVAAADALSAARPGARSESLESYIKRLHDLEEIANGFEGVQTSFALQAGREIRIMVNPGKIKDDKVTILAHKVRKKIENNLDYPGNIKVTVIRELRAVDYAK

SEQ ID NO: 4699 - protein, 418 aa, Streptococcus pneumoniae
  misc_feature (B) LOCATION 1...418
  hypothetical: YES
EKNIESKYMALTTLTKEEFQTYSDQVSSRSFMQSVQMGDLLEKRGARIVYLALKQEGEIQVAALVYSLPMLGGLHMELNSGPIYTQQDALPVFYAELKEYAKQNGVLELLVKPYETYQTFDSQGNPIDAEKKSIIQGLTDLGYQFDGLTTGYPGGEPDWLYYKDLTELTEKSLLKSFSKKGKPLVKKAETFGIRLKKLKREELSIFKNITKETSERREYSDKSLEYYEHFYDTFGEQAEFLIASLNFSEYMSKLQGEQSKLEEKLDKLRLDLSKNPHSEKKQNQLREYSSQFETFEVRKAEARDLIEKYGEEDIVLAGSLFVYMPQETTYLFSGSYTEFNKFYAPALLQKYVMLESIKRGIPKYNFLGIQGIFDGSDGVLRFKQNFNGYIVRKAGTFRYHPSPLKYKAIQLLKKIVGR

SEQ ID NO: 4700 - protein, 334 aa, Streptococcus pneumoniae
  misc_feature (B) LOCATION 1...334
  hypothetical: YES
GKNMNVKKIMSIFQSFYVDVSIEELTLTLPISFVKRFEYTQMTFHKESFLLIKEKRRGSLSSFVTQARTMGEKANMDVVLVFSKLSDSEKKQLLQARVPFVDFKGNLFFPPLGLVLNANDTEIPKELTPSEQLTWIAFLLPKGQKVVNVDLLSHVTGLPNSTIYRCLRTFKALYWLNKQNKLYTYTVSKKELFLKSVSCLFNPIKKRILLPDGDIKQIKSVSNLLYGGAYALSHSTFLAETDENTSYVIWQRKFNQLSLPLSQHVLKGKMLEIWKYRPFVSEFWNDFKNNHDKQFVDPISLYLTLKDDDDPRIEEESEALENMILQYLGEDDAS

SEQ ID NO: 4701 - protein, 364 aa, Streptococcus pneumoniae
  misc_feature (B) LOCATION 1...364
  hypothetical: YES
TENIPESDKTLECFGSIISVVGNPTPGIIGSFLVEKKPHMTYNEKRLTNSLERVHMEQLKNTTDLLGLEDKNIKILSVLKYQTHLVVQPKLDSPAPPCPHCQGKMIKYDFQKASKIPLLDCQGLPTVLHLKKRRFQCKNCLKVVVSQTSIVKKNCQISNMVRQKIAQLLLEKQSMTEIAHRLAVSTSTVIRKLREFKFETDWTKLPKVMSWDEYSFKKSKMSFIAQDFESKSILAILDGRTHAVIRNHFQRYQREVRELVEVITMDMYSPYYRLAKQLFPKAKIVLDRFHIVQHLSRAMNRVRIQIMNQFDRKSLEYRALKRFWNPRFFVSRLGLNQSTGLIYYTRIASSSVRNDSISPRFECT

SEQ ID NO: 4702 - protein, 640 aa, Streptococcus pneumoniae
  misc_feature (B) LOCATION 1...640
  hypothetical: YES
ERNMIYHFTEEYDIIVIGAGHAGVEASLAASRMGCKVLLATINIEMLAFMPCNPSIGGSAKGIVVREVDALGGEMAKTIDKTYIQMKMLNTGKGPAVRALRAQADKELYSKEMRKTVENQENLTLRQTMIDEILVEDGKAVGVRTATHQEYAAKAVIVTTGTALRGEIIIGDLKYSSGPNHSLASINLADNLKELGLEIGRFKTGTPPRVKASSINYDVTEIQPGDEVPNHFSYTSRDEDYVKDQVPCWLTYTNGTSHEIIQNNLHRAPMFTGVVKGVGPRYCPSIEDKIVRFADKERHQLFLEPEGRNTEEVYVQGLSTSLPEDVQRDLVHSIKGLENAEMMRTGYAIEYDMVLPHQLRATLETKKISGLFTAGQTNGTSGYEEAAGQGIIAGINAALKIQGKPELILKRSDGYIGVMIDDLVTKGTIEPYRLLTSRAEYRLILRHDNADMRLTEMGREIGLVDDERWARFEIKKNQFDNEMKRLDSIKLKPVKETNAKVEEMGFKPLTDAVTAKEFLRRPEVSYQDVVAFIGPAAEELDDKIIELIETEIKYEGYISKAMDQVAKMKRMEEKRIPANIDWDDIDSIATEARQKFKLINPETIGQASRISGVNPADISILMVYLEGKNRSISKTLQKSK

SEQ ID NO: 4703 - protein, 303 aa, Streptococcus pneumoniae
  misc_feature (B) LOCATION 1...303
  hypothetical: YES
KMNIQQLRYVVAIANSGTFREAAEKMYVSQPSLSISVRDLEKELGFKIFRRTSSGTFLTRRGMEFYEKSQELVKGFDIFQNQYANPEEEKDEFSVASQHYDFLPPTITAFSERYPDYKNFRIFESTTVQILDEVAQGHSEIGIIYLNNQNKKGIMQRVEKLGLEVIELIPFHTHIYLREGHPLAQKEELVMEDLADLPTVRFTQEKDEYLYYSENFVDTSASSQMFNVTDRATLNGILERTDAYATGSGFLDSDSVNGITVIRLKDNLDNRMVYVKREEVELSQAGTLFVEVMQEYFDQKRKS

SEQ ID NO: 4704 - protein, 71 aa, Streptococcus pneumoniae
  misc_feature (B) LOCATION 1...71
  hypothetical: YES
NKNMARCSNWCCGRSYTWRCGLCSDMLVVIMDFKSFIIGLVVGIFGPYMDDLIRKKFLKSSEKKTEKSIKK

SEQ ID NO: 4705 - protein, 482 aa, Streptococcus pneumoniae
  misc_feature (B) LOCATION 1...482
  hypothetical: YES
LNDIAQAATSFNRGNGSQAEQRGELDLERDKAMKAVSEYVGKMVRDAYVKSDRKRHKNTVALVNQLGNIKNRYLNEIVHSTSKSQLQELMMKSQSEVDEAVSKFEKDSFSSSSSGSSTKPETPQPENPEHQKPTTPSPDTKPSPQPEGKKPSVPDINQEKEKAKLAVVTYMSKILDDIQKHHLQKEKHRQIVALIKELDELKKQALSEIDNVNTKVEIENTVHKIFADMDAVVTKFKKGLTQDTPKEPGNKKPSAPKPGMQPSPQPEVKPQLEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPEVKPQPEKPKPDNSKPQADDKKPSTTNNLSKDKQPSNQASTNEKATNKPKKSLPSTGSISNLALEIAGLLTLAGATILAKKRMK

SEQ ID NO: 4706 - protein, 224 aa, Streptococcus pneumoniae
  misc_feature (B) LOCATION 1...224
  hypothetical: YES
CICIWVFIRGIMTYLDAFKSGTLVLPSALLLHFKELFPSSDDFLVWQFFYLQNTTGLEEMSPSQIAERIGKEISDVNQSISNLTERGLLQYRTIELNGEIELLFDASLALERLDDLFGAVHSSSDQLTPQNQLKDLVETFQQELGRLLTPFEIEDLTKTLKEDGTSADLIKEALREAVLNGKPNWKYIQAILRNWRHEGIKSVAQIEAKRAEREASNPQSSPRV

SEQ ID NO: 4707 - protein, 730 aa, Streptococcus pneumoniae
  misc_feature (B) LOCATION 1...730
  hypothetical: YES
NKRMKLDKLFEKFLSLFKKETSELEDSDSTILRRSRSDRKKLAQVGPIRKFWRRYHLTKIILILGLSAGLLVGIYLFAVAKSTNVNDLQNALKTRTLIFDREEKEAGALSGQKGTYVELTDISKNLQNAVIATEDRSFYKNDGINYGRFFLAIVTAGRSGGGSTITQQLAKNAYLSQDQTVERKAKEFFLALELSKKYSKEQILTMYLNNAYFGNGVWGVEDASKKYFGVSASEVSLDQAATLAGMLKGPELYNPLNSVEDSTNRRDTVLQNMVAAGYIDKNQETEAAEVDMTSQLHDKYEGKISDYRYPSYFDAVVNEAVSKYNLTEEEIVNNGYRIYTELDQNYQANMQIVYENISLFPRAEDGTFAQSGSVALEPKTGGVRGVVGQVADNDKTGFRNFNYATQSKRSPGSTIKPLVVYTPAVEAGWALNKQLDNHTMQYDSYKVDNYAGIKTSREVPMYQALAESLNLPAVATVNDLGVDKAFEAGEKFGLNMEKVDRVLGVALGSGVETNPLQMAQAYAAFANEGLMPEAHFISRIENASGQVIANHKNSQKRVIDKSVADKMTSMMLGTFTNGTGISSSPADYVMAGKTGTTEAVFNPEYTSDQWVIGYTPDVVISHWLGFPTTDENHYLAGSTSNGAAHVFRNIANTILPYTPGSTFTVENAYKQNGIAPANTKRQVQTNDNSQTDDNLSDIRGRAQSLVDEASRAISDAKIKEKARTLKWYSV

SEQ ID NO: 4708 - protein, 151 aa, Streptococcus pneumoniae
  misc_feature (B) LOCATION 1...151
  hypothetical: YES
RGRIVNLKMNKKERLEKIRRLVTDYQIGTQEEIVEHLKEAGITATQATVSRDIKELGIVKIPLRDNTYVYELPKSIVKSLQLAEDNIESAELMDKMINLQVIPGNTAFVKAQLIDTFADKIFSCLTDDSSILVIARSGSLAEEIFEQVKNW

SEQ ID NO: 4709 - protein, 368 aa, Streptococcus pneumoniae
  misc_feature (B) LOCATION 1...368
  hypothetical: YES
EISMTITGIIAEFNPFHNGHKYLLDQAEGLKIVAMSGNFMQRGEPAIVDKWTRTQMALENGADLVVELPFLVSVQAADFFGQGAMDILDRLGIDSLVFGTEEVRDYQKIADLYTEKGAEMEKFVENLPDSLSYPQKTQAMWKEFAGLDFSGNTPNHVLALAYAKAVAGRNIKLHPIQRQGAGYHSVNKDVDFASATALRQHQKDQDFLERFMPSVALFEQASKVIWEDYFPLLRYQILSNPDLTTIYQVNQEMAVRIKEAIKTAQSVEELVELVTTKRYTKARVRRLLTYILVQARENVLPEAIHVLGFTEKGRQHLKSLKGQVNLVSRIGKEPWDAMTQKVDQIYQLGKPSIAEQNFGRVPIRIETN

SEQ ID NO: 4710 - protein, 331 aa, Streptococcus pneumoniae
  misc_feature (B) LOCATION 1...331
  hypothetical: YES
RSSMETALISVIVPVYNVAQYLEKSIASIQKQTYQNLEIILVDDGATDESGRLCDSIAEQDDRVSVLHKKNEGLSQARNDGMKQAHGDYLIFIDSDDYIHPEMIQSLYEQLVQEDADVSSCGVMNVYANDESPQSANQDDYFVCDSQTFLKEYLIGEKIPGTICNKLIKRQIATDLSFPKGLIYEDAYYHFDLIKLAKKYVVNTKPYYYYFHRGDSITTKPYAEKDLAYIDIYQKFYNEVVKNYPDLKEVAFFRLAYAHFFILDKMLLDDQYKQFEAYSQIHRFLKGHAFAISRNPIFRKGRRISALALFINISLYRFLLLKNIEKSKKLH

SEQ ID NO: 4711 - protein, 80 aa, Streptococcus pneumoniae
  misc_feature (B) LOCATION 1...80
  hypothetical: YES
STSIVFFSLLIICFFCFWLFSWLVWFWCGSWILRLFSWFFWLRSRRWLWLFSWFFFNFIFFCCFSFSFFFCFFTICLDFF

SEQ ID NO: 4712 - protein, 405 aa, Streptococcus pneumoniae
  misc_feature (B) LOCATION 1...405
  hypothetical: YES
NRSIGQQGGPMKLSNRVLEMEESVTLAAGARAKALKAEGRDILSLTLGEPDFTTPKNIQDAAIASIRDGRASFYTVTSGLPELKAVVNSYFERFYGYSVAPNQVTVAAGAKYSLYTFFMAVVNPGDEVIIPTPYWVSYGDQVKMAEGVPVFVSAKEDNHFKVTVEQLEAARTDKTKVLVLNSPSNPTGMIYTREELLAIGNWAVENDILILADDIYGRLVYNGHEFTPISSLSEAIRKQTVVINGVSKTYAMTGWRIGYAVGEADIIAAMSKIAGQTTSNPSAVAQYAAVEALSGEQDTVESMRQAFEKRLNTIYPLLAEVPGFEVVKPQGAFYLFPNVKKAMEMKGYTDVTDFTTAILEEAEVALVTGAGFGAPENVRLSYATDLDTLKEAVERLKAFMGSEND

SEQ ID NO: 4713 - protein, 135 aa, Streptococcus pneumoniae
  misc_feature (B) LOCATION 1...135
  hypothetical: YES
FIGIRSLSEIGNPGWTPHPNSALPPRISNVDASPKAISERTSYLQVRLEFLRYPQVIQALFNVPWFGPPVRLTAPSTCSWVGHMVSGLRHDTKAPYSDSVSLRLRLFNLTSHHNVTRRFILQKARSHPLTGSNLL

SEQ ID NO: 4714 - protein, 71 aa, Streptococcus pneumoniae
  misc_feature (B) LOCATION 1...71
  hypothetical: YES
GEGMKLNEVKEFVKELRGLSQEELAKRENELKKELFELRFQAATGQLEQTARLKEVKKQIARIKTVQSEAK

SEQ ID NO: 4715 - protein, 77 aa, Streptococcus pneumoniae
  misc_feature (B) LOCATION 1...77
  hypothetical: YES
FFVLYPNMNRDVANKLNNIFGKMRNSNITRTFRNNQYLKRKKLKEFIKPCYNRYSYNFIYNKRIEMTELERKNRKIS

SEQ ID NO: 4716 - protein, 60 aa, Streptococcus pneumoniae
  misc_feature (B) LOCATION 1...60
  hypothetical: YES
FILIYFKGVLMKLRIFAEDKPAKKVFEYQLELADRTILLSTALLSGAIALAGIFSALKEK

SEQ ID NO: 4717 - protein, 216 aa, Streptococcus pneumoniae
  misc_feature (B) LOCATION 1...216
  hypothetical: YES
NILIIFMNFQLAKYSLLKKFLENIGFTTLEEYGAIFKYLIENVKTDRQIICSPHCHDDLGMAVANSLAAVKNGAGRVEGTINGIRERAENAALEEIAVALNIRQDYYQVETSIVLNETINTSEMVSRFSGIPVPKNKAVVGGNTFSHESGIHQDGVLKNPLTYEIITPELVGVKIPLGELSGRHAFVEKLRELALDFTEEDIKPLFAKFKALADKK

SEQ ID NO: 4718 - protein, 73 aa, Streptococcus pneumoniae
  misc_feature (B) LOCATION 1...73
  hypothetical: YES
KYLILEIKSLSFLSKIVNGLIQNIEENLEDDIERILKYLYICLFNEIFIIKNKVNFFDDVEFNQTLSEFLDKL

SEQ ID NO: 4719 - protein, 258 aa, Streptococcus pneumoniae
  misc_feature (B) LOCATION 1...258
  hypothetical: YES
LDLIFFLMYIKRQEEYKFMIRIENLSVSYKETLALKDISLVLHGPTITGIIGPNGAGKSTLLKGMLGIIPHQGQAFLDDKEVKKSLHRIAYVEQKINIDYNFPIKVKECVSLGLFPSIPLFRSLKAKHWKKVQEALEIVGLADYAERQISQLSGGQFQRVLIARCLVQEADYILLDEPFAGIDSVSEEIIMNTLRDLKKAGKTVLIVHHDLSKIPHYFDQVLLVNREVIAFGPTKETFTETNLKEAYGNQLFFNGGDL

SEQ ID NO: 4720 - protein, 135 aa, Streptococcus pneumoniae
  misc_feature (B) LOCATION 1...135
  hypothetical: YES
PCLIKRRKQMELVLPNNYVVIDEEEMMYLDGGGVGCNWWNSRGSFATVLDVGLAIYSGGATIYSAYAIKKAISANRGAITRTLRSLIIKHVGSAAGHLVNTALNVALTVTGFSLGGAIAYGADWADGSLDGYIFA

SEQ ID NO: 4721 - protein, 225 aa, Streptococcus pneumoniae
  misc_feature (B) LOCATION 1...225
  hypothetical: YES
MKLIVSVMPRSLEEAQALDATRYLDADIIEWRADYLPKEAILQVAPAIFEKFAGRELVFTLRTRSEGGEIDLSPEEYIHLIKEVAQFYQPDYIDFEYYSYKDVFEEMLYFPNLVLSYHNFQETPENMMEILSELTILNPKLVKVAVMAHTEQDVLDLMNYTRGFKTLNPEQEYVTISMGKVGKVSRITADVTGSSWSFASLDEVSAPGQISLASMKKIREILDEA

SEQ ID NO: 4722 - protein, 224 aa, Streptococcus pneumoniae
  misc_feature (B) LOCATION 1...224
  hypothetical: YES
THSLDSVLFVSLSLRLEMLCSAHKSVLLLRASVHGQLRIMFPMVALLKEFRAAKAVFDEEKANLLAEGVAVADNIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDTAKMEEYANRALTECSTMEEVLELQKEYVNFD

SEQ ID NO: 4723 - protein, 285 aa, Streptococcus pneumoniae
  misc_feature (B) LOCATION 1...285
  hypothetical: YES
CYLIRKCFFCRKYNMIRCKKEIRSLYMAEQDLAMQVLQQVVKLPVVKVDSSKFLVDKFSKELGPQDIPTLLEQGPTSLLSQEILDRVANACIRDNVLLASGTSVLAGLPGGLAMAITIPADVAQFYAFSLKLAQELGYIYGYEDLWVSREELSEDAQNTLLLYLGVMLGVNGTAALLRAGGITIAKQVMKTVPNKALTKTLWYPILKKVLKIFGVNLTKGGLAKGMGKFIPILGGIISGGLTFATMKPMGESLQKELSKLVNYSEVQYQEDVETIRKEAEIIEGE

SEQ ID NO: 4724 - protein, 64 aa, Streptococcus pneumoniae
  misc_feature (B) LOCATION 1...64
  hypothetical: YES
VNLILKIKEQTRKLAAGCSKHCFEVVDETDEVSNHTYGKAMLTWLEEIFEEYKIKFYPTDPSIS

SEQ ID NO: 4725 - protein, 819 aa, Streptococcus pneumoniae
  misc_feature (B) LOCATION 1...819
  hypothetical: YES
FFIMKTIGNRYVVVDLEATSTGSKAKIIQVGIVVIEDGEIVDHYTTDVNPHEPLDAHIKELTGLTDQRLAQAPDFSQVARKIFDLVEDGIFVAHNVQFDANLLAENLFFEGYELRNPRVDTVELAQVFFPELEKYSLPILCRELGIPLKHAHTALSDAQATAELLLFLREKMTQLPKGLLERLLEMADALLYESYLVIEETYRNQSILSSPDLVQVQGLYFKKTAASLELRKLSQDFSKNISLLNLEVREEQESFAKEVGLLLKDEPVFLIQAPTGIGKTYGYLLPALSQSKERQIVLSVPTKILQNQIMEEEGKRLKEVFHTDIHSLKGPQNYLKLDAFYHSLQENDENRLFRRFKMQVLVWLTETETGDLDEIGQLYRYQHFLADLRHDGNLSSQSLFVTEDFWKRSQERAETCKLLVTNHAYLVTRLEDNPEFVSDRLLIIDEVQKILLALENLLQETYDIQSIIDLIDKALVGEENRVQQRILESIRFECLYLIEQFQSGKSRKNILDSLDNLHQYFSELEVEGFDELVRYFTAEGDYWLEVTETSQKKIQISSTKSGRTLLSSLLPESCQVLGVSATLEISQRVSLADLLGYPEAKFVKIESRGKQEQEVVMVKDFPLVTETSLEVYAREVAALLVEIQAFQQPILVLFTAKDMLLAVSDLLTVSHLAQYKNGDVHQLKKRFEKGEQQILLGAASFWEGVDFSSHPFVIQVVPRLPFQNPQEPLTKKINQELNQEGKNAFYDYQLPMAIIRLKQALGRSMRREYQRSLTLILDRRIVGKRYGKQIVASLAEEATVKTISRSEVDEAIDRFFNEL

SEQ ID NO: 4726 - protein, 215 aa, Streptococcus pneumoniae
  misc_feature (B) LOCATION 1...215
  hypothetical: YES
RIVFNGCRGRGRRFRIGYLKGKRMIKKVTIEKIKSPERFLEVPLLTKEEVGQAIDKVIRQLELNLDYFKEDFPTPATFDNVYPIMDNTEWTNGFWTGELWLAYEYSQQDAFKNIAHKNVLSFLDRVNKRVELDHHDLGFLYTPSCMAEYKINGDGEAREATLKAADKLIERYQEKGGFIQAWGDLGKKEHYRLIIDCLLNIQLLFFAYQETGDQK

SEQ ID NO: 4727 - protein, 81 aa, Streptococcus pneumoniae
  misc_feature (B) LOCATION 1...81
  hypothetical: YES
KTIIKSNIYDTNQKGDQMNRVKEFRKELGISQLELAKDIGVSRQTINMIENDKYNPTLELCLNLARSLQTDLNSLFWKEDF

SEQ ID NO: 4728 - protein, 751 aa, Streptococcus pneumoniae
  misc_feature (B) LOCATION 1...751
  hypothetical: YES
SGIILFRKNILEKSMHMIALEEKITILPTLFVEKRDGRRVVFDVDKIDKALHKAADKVMDVTPLVEKRLNDLTERIITEIHSRFPQGIKIYEIQNIVEHELLEAKEYALAEEYITYRTQRDFERSKATDINFSIHKLLNKDQTVVNENANKDSDVFNTQRDLTAGIVGKSIGLQMLPKHVANAHQKGDIHYHDLDYSPYTPMTNCCLIDFKGMLENGFKIGNAEVESPKSIQTATAQISQIIANVASSQYGGCSADRIDEILAPYAEKNYQKHLKDAEEWVLPEKREDYAWKKTQKDIYDAMQSLEYEINTLFTSNGQTPFTSLGFGLGTSRFEREIQKAILNIRIKGLGSEHRTAIFPKLIFTLKRGLNLEEGTPNYDIKQLALECATKRMYPDVLSYDKIVDLTGSFKVPMGCRSFLQGWKDENGVEVNSGRMNLGVVTVNLPRIALESEGDMNKFWEIFNERMNIAEDALVYRVERTKEATPANAPILYQYGAFGHRLGKEESVDQLFKNRRATVSLGYIGLYEVATVFFGNSWESNPDAKEFTLDIIHDMKRRVEEWSDQYGYHFSIYSTPSESLTDRFCRLDIDKFGSIPDITDKEYYTNSFHYDVRKNPTPFEKLDFEKVYPEAGASGGFIHYCEYPVLQQNPKALEAVWDYAYDRVGYLGTNTPIDRCYKCDFEGDFEPTERGFACPNCGNSDPKTVDVVKRTCGYLGNPQARPMVNGRHKEIAARVKHMNGSTIKIAGHQVTN

SEQ ID NO: 4729 - protein, 61 aa, Streptococcus pneumoniae
  misc_feature (B) LOCATION 1...61
  hypothetical: YES
ESSFSSFYYSTFLNLGLLDSMLLSIYSEKKAFLQKKANSLFEIFSSLLDSPVYLCYNERRI

SEQ ID NO: 4730 - protein, 139 aa, Streptococcus pneumoniae
  misc_feature (B) LOCATION 1...139
  hypothetical: YES
QQIIKMLFLSHKKAVSIKERGGLILLHCCSRCDFFERKNKMKTKKHRLLALALISSFTLLGAASAAVQYPDGGVWTYGEGSGGGWAFSNYYHGKKYHYSSLVSRWNSHSDKGEAPAGKTSYAWIWTKWGEQVAFYCDYD

SEQ ID NO: 4731 - protein, 439 aa, Streptococcus pneumoniae
  misc_feature (B) LOCATION 1...439
  hypothetical: YES
EEIMSMFLDTAKIKVKAGNGGDGMVAFRREKYVPNGGPWGGDGGRGGNVVFVVDEGLRTLMDFRYNRHFKADSGEKGMTKGMHGRGAEDLRVRVSQGTTVRDAETGKVLTDLIKHGQEFIVAHGGRGGRGNIRFATPKNPAPEISENGEPGQERELQLELKILADVGLVGFPSVGKSTLLSVITSAKPKIGAYHFTTIVPNLGMVRTQSGESFAVADLPGLIEGASQGVGLGTQFLRHIERTRVILHIIDMSASEGRDPYEDYLAINKELESYNLRLMERPQIIVANKMDMPESQENLEEFKKKLAENYDEFEELPAIFPISGLTKQGLATLLDATAELLDKTPEFLLYDESDMEEEAYYGFDEEEKAFEISRDDDATWVLSGEKLMKLFNMTNFDRDESVMKFARQLRGMGVDEALRARGAKDGDLVRIGKFEFEFVD

SEQ ID NO: 4732 - protein, 74 aa, Streptococcus pneumoniae
  misc_feature (B) LOCATION 1...74
  hypothetical: YES
PTSFSFHTLQKSLQTASTSPWPLYMLLTSSVLSATSKQCFELTSSVLSATSKQCFEQPAASFLVCSLIFIEYQI

SEQ ID NO: 4733 - protein, 171 aa, Streptococcus pneumoniae
  misc_feature (B) LOCATION 1...171
  hypothetical: YES
HLIICVFSKWISRVEDFSHIILFENLCKLRQLPSATSKQYFELTSSVLSATSKQYFELTSSVLSATSKQYFELTSSVLSATSKQYFELTSSVLSATSKQYFELTSSVLSATSKQYFELTSSVLSATSKQYFELTSSVLSTTSKQCFEQPVASFLVCALIFIEYKGKYSELK

SEQ ID NO: 4734 - protein, 90 aa, Streptococcus pneumoniae
  misc_feature (B) LOCATION 1...90
  hypothetical: YES
STIMIFLIRMIYNAVDIYSLILIAFAVMSWFPGAYESSLGRWIVALVKPVLAPLQRLPLQIAGLDLSVWVAIVLVRFLGENLVRFLAMIG

SEQ ID NO: 4735 - protein, 93 aa, Streptococcus pneumoniae
  misc_feature (B) LOCATION 1...93
  hypothetical: YES
IEVIRMRLDKYLKVSRIIKRRTVAKEVADKGRIKVNGILAKSSTDLKVNDQVEIRFGNKLLLVKVLEMKDSTKKEDAAGMYEIISETRVEENV

SEQ ID NO: 4736 - protein, 185 aa, Streptococcus pneumoniae
  misc_feature (B) LOCATION 1...185
  hypothetical: YES
RLSFTSALFLLKMRKFRYNSQTRSRFKERGGFVMRFKNTSDHIEAYIKAILDQSGIVELQRSQLADTFQVVPSQINYVIKTRFTESRGYLVESKRGGGGYIRIGRIEFSSHHEMLRELLYSIGERVSQEIYEDILQLLVEQELMTKQEMNLLESVALDRVLGEEAPVVRANMLRQIIQEVDRKGK

SEQ ID NO: 4737 - protein, 133 aa, Streptococcus pneumoniae
  misc_feature (B) LOCATION 1...133
  hypothetical: YES
LKSFSKNHLFLIFNPICCMIREKKGDRDMAFTNTHMRSASFGIVTSLPDDIIDSFWYIIDHFLKNVFELEEELEFQLLNNQGKITFHFSSQHLPTAIDFDFNHPFDPRYPPRVLVLDMDGRETILLPEENDLF

SEQ ID NO: 4738 - protein, 144 aa, Streptococcus pneumoniae
  misc_feature (B) LOCATION 1...144
  hypothetical: YES
VISMLIGIPKEIKNNENRVALTPAGVHSLVSRGHRVLIETNAGLGSGFTDADYQKQGAEIVATAGEAWAAELVVKVKEPLSSEYGYFRDDLLLFTYLHMAAAPELADAMLAAKTTGIAYETVRDNQGQLPLLVPMSEVADRMAV

SEQ ID NO: 4739 - protein, 197 aa, Streptococcus pneumoniae
  misc_feature (B) LOCATION 1...197
  hypothetical: YES
KYSIYKLKCDRNENKGDVGKKAENLIQGQFEGSKAMEKCYTDVTEFAIPASTQKLYLSPVLDGFNSEIIAYNLSTSPNLEQVKSMLEQAFTEKHYENTILHSDQGWQYRHDSYHRFLESKGIQASMSRKGNSPDNGMMESFFGILKSEMFYGFEKSFQSLKQLEQAIIDYIDYYNNKRIKVKLKGLIPVQYRTKSFG

SEQ ID NO: 4740 - protein, 136 aa, Streptococcus pneumoniae
  misc_feature (B) LOCATION 1...136
  hypothetical: YES
KYSIYKLKCDRNENKGDVGKKAENLIQGQFEGSKTMEKCYTDVTEFAIPASTQKLYLSPVLDGFNSEIIAYNLSTSPNLEQVQTMLEQAFTEKYYENTILHSDQGWQYRHDSYHRFLRVREFKHLCHARETAKTTV

SEQ ID NO: 4741 - protein, 197 aa, Streptococcus pneumoniae
  misc_feature (B) LOCATION 1...197
  hypothetical: YES
KYSIYKLKCDRNENKGDVGKKAENLIQGQFEGSKTMEQCYIDVTEFAIPASTQKLYLSPVLDGFNSEIIAYNLSTSPNLEQVQTMLEQAFKEKHYENTILHSDQGWQYRHDSYHRFLESKGIQASMSRKGNSPDNGMMESFFGILKSEMFYGYEKSFQSLKQLEQAIVDYIDYYNNKRIKVKLKGLSPVQYRTKSFG

SEQ ID NO: 4742 - protein, 366 aa, Streptococcus pneumoniae
  misc_feature (B) LOCATION 1...366
  hypothetical: YES
TSSIPMIWSQWPNKLFLKQHLAISSSGAEDTLTLRENIRAFNHKLIVPHTLCDVENPSTEIEFAGEKLSSPIIMAPVAAHKLANEQGEVATARGVHEFGSLYTTSSYSTVDLPEISEALQGTPHWFQFYFSKDDGINRHIMDRVKAEGYKAIVLTADATVGGNREVDKRNGFVFPVGMPIVEEYLPEGAGKSMDFVYKSAKQRLSPRDVEFIAEYSGLPVYVKGPQCREDVERSLAAGASGIWVTNHGGRQIDGGPAAFDSLQEVAEAVDRRVPIVLNSGVRRGQHVFKALASGADLVAIGRPVIYGLALGGSVGVRQVFEHLNAELKTVMQLSGAQTIEDVKHFKLRHNPYNPTFPVDPRDLKLY

SEQ ID NO: 4743 - protein, 75 aa, Streptococcus pneumoniae
  misc_feature (B) LOCATION 1...75
  hypothetical: YES
VLSIVLAISPPRASTSRTTIPLAEPPIEGLQGMKASISILMVASRTLQPIRLAAKEASTPACPAPITIISYSSVK

SEQ ID NO: 4744 - protein, 136 aa, Streptococcus pneumoniae
  misc_feature (B) LOCATION 1...136
  hypothetical: YES
YTVFMTDLSKQLLEKAHGGLKINPDEQRRYLGTFEERVLGYVDIDTANSPQLEKGFLFILENLQEKAEPLFVKISPTIEFDKQVFYLKEAKETDSQATIVSEEHITSPFGLVIHSNAPVQVEEIRPSTCFSKTLGS

SEQ ID NO: 4745 - protein, 257 aa, Streptococcus pneumoniae
  misc_feature (B) LOCATION 1...257
  hypothetical: YES
VKSMPRSLCWKDEYTEYMHEICPGRLTPEVTRLLNEKFGTNYNKSQIGGVRKRLGLAVGKVYQGRLLTKEQHDYLVLIQKNKISRNVANEMNQKFGLSLTEKQIKSYRRNNNLHSGLTGRFEKGQTPHNKGKKYPNMPKNGGQFKKGNRPPNYVPVGTINYTTNGYPKEKIGEPNQWVLKHRKVWEDHHGLIPKGYSIVFLDGDKTNYDISNLACLSKNEIARMNQNHLFTSNADLTKSGIGLTKLTNKIREVEKNG

SEQ ID NO: 4746 - protein, 64 aa, Streptococcus pneumoniae
  misc_feature (B) LOCATION 1...64
  hypothetical: YES
KFPILGSKQTPFITTSAFKLLLSAKESSSLKKATRRAKNVLEKSLIASASVGETNITFLILAVL

SEQ ID NO: 4747 - protein, 892 aa, Streptococcus pneumoniae
  misc_feature (B) LOCATION 1...892
  hypothetical: YES
LFPMVFFDSFLYNGCMDKKKLLLIDGSSVAFRAFFALYQQLDRFKNAAGLHTNAIYGFQLMLSHLLERVEPSHILVAFDAGKTTFRTEMYADYKGGRAKTPDEFREQFPFIRELLDHMGIRHYELAQYEADDIIGTLDKLAEQDGFDITIVSGDKDLIQLTDEHTVVEISKKGVAEFEAFTPDYLMEEMGLTPAQFIDLKALMGDKSDNIPGVTKVGEKTGIKLLLEHGSLEGIYENIDGMKTSKMKENLINDKEQAFLSKTLATIDTKAPIAIGLEDLVYSGPDVENLGKFYDEMGFKQLKQALNVSSADVAKGLDFTIVDQISQDMLSEESIFHFELFGENYHTDNLVGFAWSCGDKLYATDKLELLQDPIFKDFLEKTSLRVYDFKKVKVLLQRFGVDLQAPAFDIRLAKYLLSTVEDNEIATIASLYGQTYLVDDETFYGKGVKKAIPEREKFLEHLACKLAVLVETEPILLEKLSENGQLELLYDMEQPLAFVLAKMEIAGIVVKKETLLEMQAENELVIEKLTQEIYELAGEEFNVNSPKQLGVLLFEKLGLPLEYTKKTKTGYSTAVDVLERLAPIAPIVKKILDYRQIAKIQSTYVIGLQDWILADGKIHTRYMQDLTQTGRLSSVDPNLQNIPARLEQGRLIRKAFVPEWEDSVLLSSDYSQIELRVLAHISKDEHLIKAFQEGADIHTSTAMRVFGIERPDNVTANDRRNAKAVNFGVVYGISDFGLSNNLGISRKEAKAYIDTYFERFPGIKNYMDEVVREARDKSYVETLFKRRRELPDINSRNFNIRGFAERTAINSPIQGSAADILKIAMIQLDKALVAGGYQTKMLLQVHDEIVLEVPKSELVEMKKLVKQTMEEAIQLSVPLIADENEGATWYEAK

SEQ ID NO: 4748 - protein, 91 aa, Streptococcus pneumoniae
  misc_feature (B) LOCATION 1...91
  hypothetical: YES
MTPITKPTPTTCMAISLEIPKRLQATGIRRREPPAIPEAPQAEIAATTLRTKAVAKSTGIPRVLTAARVKRLMVIATPAILIVEPSGIETE

SEQ ID NO: 4749 - protein, 389 aa, Streptococcus pneumoniae
  misc_feature (B) LOCATION 1...389
  hypothetical: YES
MKPIDRFSYLKNNRVSQDTSSLVQCYLPIIGQEALSLYLYTISFWDNGRKEYLFSSILNHLNFGMDRLIKSLKILSAFNLLTLYQKGDVYQLALHAPLSSQDFLGHPVYRRLLEKKIGDVAVEDLKVESADGEEIPVSLNQVFPELAELGSQEYLGLKKKVANDFDLDHFRQLMARDGLRFADEQSDVLNLFAIAEEKKWTWFETYQLAKSTAVSQVISTKRMREKIAQKPVSSDFSLKEAIIIKEAKSKTALQFLAEIKQTRKGTITQTERELLQQMAGLGLLDEVINIILLLTFNKVDSANINEKYAMKVANDYAYQKIHSAEEAVLRIRERGQKAKTQKQNQTAPAKTNIPKWSNPEYKNTSSAEELEEMERQTLELLAKLDNGGD

SEQ ID NO: 4750 - protein, 83 aa, Streptococcus pneumoniae
  misc_feature (B) LOCATION 1...83
  hypothetical: YES
EDTIMKKTVYKKLGISIIASTLLASQLSTVSALSVISSTGEEYEVSETLEKGPGSNDSSLSEISPTYGSYYQKQSEVLSVMMI

SEQ ID NO: 4751 - protein, 109 aa, Streptococcus pneumoniae
  misc_feature (B) LOCATION 1...109
  hypothetical: YES
LSTMMMALIRPKSKRFIMDHKAYMYVLECRDGSYYIGYTTDMRRRLAIHNSGKGAKYTRARLPVKLIYAQGFASKEEAMSAEALLKRKKRPQKEEFLSENQDRNLLRLF

SEQ ID NO: 4752 - protein, 331 aa, Streptococcus pneumoniae
  misc_feature (B) LOCATION 1...331
  hypothetical: YES
IKTMTSTKQHKKVILVGDGAVGSSYAFALVNQGIAQELGIIEIPQLHEKAVGDALDLSHALAFTSPKKIYAAQYSDCADADLVVITAGAPQKPGETRLDLVGKNLAINKSIVTQVVESGFKGIFLVAANPVDVLTYSTWKFSGFPKERVIGSGTSLDSARFRQALAEKLDVDARSVHAYIMGEHGDSEFAVWSHANIAGVNLEEFLKDTQNVQEAELIELFEGVRDAAYTIINKKGATYYGIAVALARITKAILDDENAVLPLSVFQEGQYGVENVFIGQPAVVGAHGIVRPVNIPLNDAETQKMQASAKELQAIIDEAWKNPEFQEASKN

SEQ ID NO: 4753 - protein, 74 aa, Streptococcus pneumoniae
  misc_feature (B) LOCATION 1...74
  hypothetical: YES
YETIAKTFIEINFTFPIDLFSSYFNLLYNSPCCGWILFSLLILFETLFKPRQLHLAVGMVTDFVSSIHNLKTVF

SEQ ID NO: 4754 - protein, 131 aa, Streptococcus pneumoniae
  misc_feature (B) LOCATION 1...131
  hypothetical: YES
YETIAKTFIEINFTFPIDLFSSYFNPLYIMVSNLHQNDKINQLISDYKQNMKAFYITIEKFIRDDESLKCYFTKVISSRSKVTSLDQIEADKTIQRKYSSELKKFIGFYNEIICEENSFLHVRKRWSSWFR

SEQ ID NO: 4755 - protein, 210 aa, Streptococcus pneumoniae
  misc_feature (B) LOCATION 1...210
  hypothetical: YES
PMTIELLTPFTKVELEPEIKEKKRKQVGILGGNFNPVHNAHLIVADQVRQQLGLDQVLLMPEYQPPHVDKKETIPEHHRLKMLELAIEGIDGLVIETIELERKGISYTYDTMKILTEKNPDTDYYFIIGADMVDYLPKWYRIDELVDMVQFVGVQRPRYKVGTSYPVIWVDVPLMDISSSMVRAFLAQGRKPNFLLPQPVLDYIEKEGLY

SEQ ID NO: 4756 - protein, 196 aa, Streptococcus pneumoniae
  misc_feature (B) LOCATION 1...196
  hypothetical: YES
LMTMKAMKTMMRITDNQHKIIKEKFVEEYPKLSNLLLDRTLESLSQDERIFIFPNDLTHTPDLDKKQKILETINQEIKTGNVIGFLGYGQERLTISSRFSDESNDHFLHYLLNKVLHINLTSLDVALSREERLYQLLMYLFPKYLQAAIRKGLYKEYHRFSHNDSHVKGVIDVRNHPQEKSSFHGKYCLHNERVHL

SEQ ID NO: 4757 - protein, 121 aa, Streptococcus pneumoniae
  misc_feature (B) LOCATION 1...121
  hypothetical: YES
RMTIKLVATDMDGTFLYGNGRFDMDRLKSLLASYKEKGIYFAVASGRGFLSLEKLFAGVRDDIIFIAENGSLVKYQGQDLYEATMSRDFYLATFEKLKTSPYVDINKLLLTGKKVHMSRYG

SEQ ID NO: 4758 - protein, 68 aa, Streptococcus pneumoniae
  misc_feature (B) LOCATION 1...68
  hypothetical: YES
RRTILAGIPTTVTSLGTSATTTAAAPTLAFSPISTGPITWAWADMRAPFRTVGWRLPQSFPVPPRVTP

SEQ ID NO: 4759 - protein, 72 aa, Streptococcus pneumoniae
  misc_feature (B) LOCATION 1...72
  hypothetical: YES
TRAIQIGSRLLVFRQLERKKCYFLQLYLTERLRRHTSRKICLIMPVESVTTPKDNKTIIPYLTQKCKKKSHT

SEQ ID NO: 4760 - protein, 834 aa, Streptococcus pneumoniae
  misc_feature (B) LOCATION 1...834
  hypothetical: YES
KFPFCGIIDKVRKSMQNQLNELKRKMLEFFQQKQKNKKSARPGKKGSSTKKSKTLDKSVIFPAILLSIKALFNLLFVLGFLGGMLGAGIALGYGVALFDKVRVPQTEELVNQVKDISSISEITYSDGTVIASIESDLLRTSISSEQISENLKKAIIATEDEHFKEHKGVVPKAVIRATLGKFVGLGSSSGGSTLTQQLIKQQVVGDAPTLARKAAEIVDALALERAMNKDEILTTYLNVAPFGRNNKGQNIAGARQAAEGIFGVDASQLTVPQAAFLAGLPQSPITYSPYENTGELKSDEDLEIGLRRAKAVLYSMYRTGALSKDEYSQYKDYDLKQDFLPSGTVTGISRDYLYFTTLAEAQERMYDYLAQRDNVSAKELKNEATQKFYRDLAAKEIENGGYKITTTIDQKIHSAMQSAVADYGYLLDDGTGRVEVGNVLMDNQTGAILGFVGGRNYQENQNNHAFDTKRSPASTTKPLLAYGIAIDQGLMGSETILSNYPTNFANGNPIMYANSKGTGMMTLGEALNYSWNIPAYWTYRMLREKGVDVKGYMEKMGYEIPEYGIESLPMGGGIEVTVAQHTNGYQTLANNGVYHQKHVISKIEAADGRVVYEYQDKPVQVYSKATATIMQGLLREVLSSRVTTTFKSNLTSLNPTLANADWIGKTGTTNQDENMWLMLSTPRLTLGGWIGHDDNHSLSRRAGYSNNSNYMAHLVNAIQQASPSIWGNERFALDPSVVKSEVLKSTGQKPGKVSVEGKEVEVTGSTVTSYWANKSGAPATSYRFAIGGSDADYQNAWSSIVGSLPTPSSSSSSSSSSSDSSNSSTTRPSSRARR

SEQ ID NO: 4761 - protein, 69 aa, Streptococcus pneumoniae
  misc_feature (B) LOCATION 1...69
  hypothetical: YES
YKIKKKKKKKNKKKKKKKKKKKKKKKKKKKEKKKKKKKKKKKKKKKKKKKKKKKKKKNFITSQKQRIMW

SEQ ID NO: 4762 - protein, 192 aa, Streptococcus pneumoniae
  misc_feature (B) LOCATION 1...192
  hypothetical: YES
MSQIERIKQAIMADSQNASYTERGIEPLFAAPKTARINIIGQAPGLKTQEAGLYWKDKSGDRLRDWLGVDEDTFYNSGYFAVLPMDFYFPGHGKSGDLPPRTGFAEKWHPQVLQELPDIQLTLLIGQYAQAYYLQEKISGKVTERVKHYKDYLPAYFPLVHPSPRNQIWMAKNPWFEAEVVPDLKKRIKTIL

SEQ ID NO: 4763 - protein, 217 aa, Streptococcus pneumoniae
  misc_feature (B) LOCATION 1...217
  hypothetical: YES
AYQIGETMTSITAIFFDLDGTLVDSSIGIHNAFTYTFKELGVPSPDAKTIRGFMGPPLESSFATCLSKDQISEAVQIYRSYYKAKGIYEAQLFPQIIDLLEELSSSYPLYITTTKDTSTAQDMAKNLEIHHFFDGIYGSSPEAPHKADVIHQALQTHQLAPEQAIIIGDTKFDMLGARETGIQKLAITWGFGEQADLLNYQPDYIAHKPLEVLAYFQ

SEQ ID NO: 4764 - protein, 321 aa, Streptococcus pneumoniae
  misc_feature (B) LOCATION 1...321
  hypothetical: YES
SHQIKKDSKENPMKFNPNQRYTRWSIRRLSVGVASVVVASGFFVLVGQPSSVRADVVNPTPGQVLPEETSGTKEGDLSEKPGDTVLTQAKPEGVTGNTNSLPTPTERTEVSEETNSSSLDTLFEKDEEAQKNPELTDVLKETVDTADVDGTQASPAETTPEQVKGGVKENTKDSIDVPAAYLEKAEGKGPFTAGVNQVIPYELFAGDGMLTRLLLKASDNAPWSDNGTAKNPALPPLEGLTKGKYFYEVDLNGNTVGKQGQALIDQLRANGTQTYKATVKVYGNKDGKADLTNLVATKNVDININGLVAKENCRKSRCRQR

SEQ ID NO: 4765 - protein, 216 aa, Streptococcus pneumoniae
  misc_feature (B) LOCATION 1...216
  hypothetical: YES
GDQIMNLLIMGLPGAGKGTQAAKIVEQFHVAHISTGDMFRAAMANQTEMGVLAKSYIDKGELVPDEVTNGIVKERLSQDDIKETGFLLDGYPRTIEQAHALDKTLAELGIELEGVINIEVNPDSLLERLSGRIIHRVTGETFHKVFNPPVDYKEEDYYQREDDKPETVKRRLDVNIAQGEPIIAHYRAKGLVHDIEGNQDINDVFSDIEKVLTNLK

SEQ ID NO: 4766 - protein, 663 aa, Streptococcus pneumoniae
  misc_feature (B) LOCATION 1...663
  hypothetical: YES
NVQIELEVSKLRMLLTKREEQLLKAFLHVGKLSMQDMTEILQVSSRTIYRTLSDLTDSMEQYGIEITKHGKYYILTGELDDLPTELEVLVEYSPQERQELITYRLLTESGFVTNEALQECTKVSNVTIIQDISDIDKRLLDFDLKIERQKGYRISGDSVGKRRFLAILLTNCISVADFSTGNFGSFDILEADRTRLASQIVNKQLSGFPDMDARMKMFFAILLSLIGQEQNIENSPNTSKQALEISQKIFQAYSKQTAQFYSIQEIIYFASILDELIIKRQDNPLFTEKFDGEFFYNISNLIDTVSMYTKIDFFKDKVLFNFLFHHIRLSLGVPILFQSENLPESVQILVERNKFLYTVISLLVNDIFPKYLHTDYEYGMIALHFISSLGRSPEIYPVRVLLLTDERRVTRDLLVSKIKSVAPFVELIDIQSLVDYHSIDLSQYDYILSTKPLTNQEIDVISSFPTVKELLELQERLQYVQAHRTIVARDAIAPEKSYDLQDYLISSSQLLSQFELVQLENNQSFEHTVEQIIQYQKNVSDRDYLTRKLLSHFQNSPMAIPNTGLVLLHSQSSKVTTNSFTMFELKLPISALSMKREEEEVKRCLLMLMSKEASEEARDLMTAISQSIIENHLYTEIYKTGNQSIIYQMLNTIFNEKIKKLEN

SEQ ID NO: 4767 - protein, 65 aa, Streptococcus pneumoniae
  misc_feature (B) LOCATION 1...65
  hypothetical: YES
SRQIPYFQKVYHFYFNFLDEKKDIFMKKLHRAFNVFSCFQTRKKGATEPNSLSHFKACEKRPLGS

SEQ ID NO: 4768 - protein, 111 aa, Streptococcus pneumoniae
  misc_feature (B) LOCATION 1...111
  hypothetical: YES
IFKMKKMMTFLKKAKVKAFTLVEMLVVLLIISVLFLLFVPNLTKQKEAVNDKGKAAVVKVVESQAELYSLEKNEDASLSKLQADGRITEEQAKAYKEYHDKNGVANRKVND

SEQ ID NO: 4769 - protein, 270 aa, Streptococcus pneumoniae
  misc_feature (B) LOCATION 1...270
  hypothetical: YES
EFKMKQLTVEDAKQIELEILDYIDTLCKKHNINYIINYGTLIGAVRHEGFIPWDDDIDLSMPREDYQRFINIFQKEKSKYKLLSLETDKNYFNNFIKITDSTTKIIDTRNTKTYESGIFIDIFPIDRFDDPKVIDTCYKLESFKLLSFSKHKNIVYKDSLLKDWIRTAFWLLLRPVSPRYFANKIEKEIQKYSRENGQYMAFIPSKFKEKEVFPSGTFDKTIDLPFENLSLPAPEKFDTILTQFYGDYMTLPPEEKRFYSHEFHAYKLED

SEQ ID NO: 4770 - protein, 63 aa, Streptococcus pneumoniae
  misc_feature (B) LOCATION 1...63
  hypothetical: YES
LIKIMENIDMFKSNHERRMRYSIRKFSVGVASVAVASLFMGSVVHATEKEGSTQAANVIKLVI

SEQ ID NO: 4771 - protein, 1529 aa, Streptococcus pneumoniae
  misc_feature (B) LOCATION 1...1529
  hypothetical: YES
GIKMKKSTVLSLTTAAVILAAYAPNEVVLADTSSSEDALSISDKEKVVVDKETENKEKHKDIHSAMETSQDFKEKKIAVIKEKEVVSKTPVIDTKTSNEENSNKSQGDHTDSFVNKNTENPKKEDKVVYIAEFKDKESGEKAIKELSSLKNTKVLYTYDRIFNGSAIETIPDNLDKIKQIEGISSVERAQKVQPMMNHARKEIGVEEAIDYLKSINAPFGKNFDGRGMVISNIDTGTDYRHKAMRIDDDAKASMRFKKEDLKGTDKNFWLSDKIPHAFNYYNGGKITVEKYDDGRDYFDPHGMHIAGILAGNDTEQDIKNFNGIDGIAPNAQIFSYKMYSDAGSGFAGDETMFHAIEDSIKHNVDVVSVSSGFTGTGLVGEKYWQAIRALRKAGIPMVVATGNYATSASSSSWDLVANNHLKMTDTGNVTRTAAHEDAIAVASAKNQTVEFDKVNIGGQSFKYRNIGAFFDKNKITTNEDGTKAPSKLKFVYIGKGQDQDLIGLDLRGKIAVMDRIYTKDLKNAFKKAMDKGARAIMVVNTVNYYNRDNWTELPAMGYEADEGTKSQVFSISGDDGVKLWNMINPDKKTEVKRNNKEDFKDKLEQYYPIDMESFNSNKPNVGDEKEIDFKFAPDTDKELYKEDIIVPAGSTSWGPRIDLLLKPDVSAPGKNIKSTLNVINGKSTYGYMSGTSMATPIVAASTVLIRPKLKEMLEKPVLKNLKGDDKIDLTSLTKIALQNTARPMMDATSWKEKSQYFASPRQQGAGLINVANALRNEVVATFKNTDSKGLVNSYGSISLKEIKGDKKYFTIKLHNTSNRPLTFKVSASAVTTDSLTDRLKLDETYKDEKSPDGKQIVPEIHPEKVKGANITFEHDTFTIGANSSFDLNAVINVGEAKNKNKFVESFIHFESVEEMEALSSNGKKTDFQPSLSMPLMGFAGNWNHEPILDKWAWEEGSKSKTMEGYDDDGKPKIPGTLNKGIGGEHGIDKFNPAGVIQNRKDKNRTSLDQDPDLFAFNNQGVHAESTSGSKIANIYPLDSNGNPQDAQLERGLTPSPLVLRSAEEGLISIVNTNKEGENQKDLKVVSREHFIRGILNSKGNDAKGIKSSKLKVWGDLKWDGLIYNPRGREENAPESKDNQDPATKIRGQFEPIAEGQYFYKFKYRLTKDYPWQVSYIPVKIDNTAPKIVSVDFSNPEKIKLITKDTYHKVKDQYKNETLFARDQKEHPEKFDEIANEVWYAGAALVNEDGEVEKNLEVTYAGEGQGRNRKLDKDGNTIYEISGAGDLRGKIIEVIALDGASNFTKIHRIKFANQADEKGMISYYLVDPDQDSSKYQKLGEIPESKFKNLKNVKDDSLNKETAEVENNLLVDNQSIEGKSLFNIHKTISTIRDFENKDLKKLIKKKYKQEDDFVNGGTRTVERDYKYDDKGNIIAYDDGTDLEYETEKLDEIKSKIYGVLSPSKDGHFEILGKISNVSKNAKVYYGNNYKSIEIKATKYDFHSKTMTFDLYANINDIVDGISFCRRYEIIC

SEQ ID NO: 4772 - protein, 479 aa, Streptococcus pneumoniae
  misc_feature (B) LOCATION 1...479
  hypothetical: YES
GIKMSILEVKNLSHGFGDRAIFEDVSFRLLKGEHIGLVGANGEGKSTFMSIVTGKMLPDEGKVEWSKYVTAGYLDQHSVLAERQSVRDVLRTAFDELFKAEARINDLYMEMAEDGADVDALMEEVGELQDRLESRDFYTLDAKIDEVARALGIMDFGMDTDVTSLSGGQRTKVLLAKLLLEKPDILLLDEPTNYLDAEHIDWLKRYLQNYENAFVLISHDIPFLNDVINIVYHVENQQLTRYSGDYYQFQEVYAMKKSQLEAAYERQQKEIADLKDFVARNKARVATRNMAMSRQKKLDKMDIIELQSEKPKPSFDFKPARTPGRFIFQAKNLQIGYDRPLTKPLNLTFERNQKVAIIGANGIGKTTLLKSLLGIISPIAGEVERGDYLELGYFEQEVEGGNRQTPLEAVWNAFPALNQAEVRAALARCGLTTKHIESQIQVLSGGEQAKVRFCLLMNRENNVLVLDEPHQPFGCGCKG

SEQ ID NO: 4773 - protein, 428 aa, Streptococcus pneumoniae
  misc_feature (B) LOCATION 1...428
  hypothetical: YES
GSKMREPDFLNHFLKKGYFKKHAKAVLALSGGLDSMFLFKVLSTYQKELEIELILAHVNHKQRIESDWEEKELRKLAAEAELPIYISNFSGEFSEARARNFRYDFFQEVMKKTGATALVTAHHADDQVETILMRLIRGTRLRYLSGIKEKQVVGEIEIIRPFLHFQKKDFPSIFHFEDTSNQENHYFRNRIRNSYLPELEKENPRFRDAILGIGNEILDYDLAIAELSNNINVEDLQQLFSYSESTQRVLLQTYLNRFPDLNLTKAQFAEVQQILKSKSQYRHPIKNGYELIKEYQQFQICKISPQADEKEDELVLHYQNQVAYQGYLFSFGLPLEGESIQQIPVSRETSIHIRHRKTGDVLIQNGHRKKLRRLFIDLKIPMEKRNSALIIEQFGEIVSILGIATNNLSKKTKNDIMNTVLYIEKIDR

SEQ ID NO: 4774 - protein, 128 aa, Streptococcus pneumoniae
  misc_feature (B) LOCATION 1...128
  hypothetical: YES
YNKIIENAIKRRRGMSVMEHLFKFLLLAPYFYFDNWIEKANRNSKFFPIFYYFYWIYIPFYSLFSLAWTVVSVLFFNTVLRNVTDIKLWGIWFLFILLAIGMNWLTYSCFKEMFRLRQELGKSKGGRH

SEQ ID NO: 4775 - protein, 108 aa, Streptococcus pneumoniae
  misc_feature (B) LOCATION 1...108
  hypothetical: YES
TGKIHKIGELTRCVTNGLDGARARTWYHDHICWRTTAQWNNHRVNIIDTPGHVDFTIEVQRSLRVLDGAVTVLDSQSGVEPQTETVWRQQLSTESTYRICQQNGQNRC

SEQ ID NO: 4776 - protein, 221 aa, Streptococcus pneumoniae
  misc_feature (B) LOCATION 1...221
  hypothetical: YES
GGKIVGQKVHPIGMRVGIIRDWDAKWYAEKEYADYLHEDLAIRKFVQKELADAAVSTIEIERAVNKVNVSLHTAKPGMVIGKGGANVDALRAKLNKLTGKQVHINIIEIKQPDLDAHLVGEGIARQLEQRVAFRRAQKQAIQRAMRAGAKGIKTQVSGRLNGADIARAEGYSEGTVPLHTLRADIDYAWEEADTTYGKLGVKVWIYRGEVLPARKNTKGGK

SEQ ID NO: 4777 - protein, 93 aa, Streptococcus pneumoniae
  misc_feature (B) LOCATION 1...93
  hypothetical: YES
EIKIKLVFGKFSLIAFKSLDSVMVSSAEVASSRMRNGAWRKTARAIDNLCFCPPEKFRPPASTRASKSPSFSLTKSLACAISKACQSSWSDTS

SEQ ID NO: 4778 - protein, 89 aa, Streptococcus pneumoniae
  misc_feature (B) LOCATION 1...89
  hypothetical: YES
SSKIVYTGTSPCPLSEQIIFQSPSNGLNTMGTSGLEPPTSRLSGVRSNHLSYAPKSKTWYKEQSSKRVTRIELATTAWKAVVLPLNYTR

SEQ ID NO: 4779 - protein, 375 aa, Streptococcus pneumoniae
  misc_feature (B) LOCATION 1...375
  hypothetical: YES
FNKIKEKNMVKYGVVGAGYFGAELARYMQKNDGAEITLLYDPDNAEAIAEELGAKVASSLDELVSSDEVDCVIVATPNNLHKAPVIKAAQHGKNVFCEKPIALSYQDCREMVDACKENNVTFMAGHIMNFFNGVHHAKELINQGVIGDVLYCHTARNGWEEQQPSVSWKKIREKSGGHLYHHIHELDCVQFLMGGMPETVTMTGGNVAHEGEHFGDEDDMIFVNMEFSNKRFALLEWGSAYRWGEHYVLIQGSKGAIRLDLFNCKGTLKLDGQESYFLIHESQEEDDDRTRIYHSTEMDGAIAYGKPGKRTPLWLSSVIDKEMRYLHEIMEGAPVSEEFAKLLTGEAALEAIATADACTQSMFEDRKVKLSEIVK

SEQ ID NO: 4780 - protein, 441 aa, Streptococcus pneumoniae
  misc_feature (B) LOCATION 1...441
  hypothetical: YES
DNKIKLLQELKEQVEVGTAINASNIEHSKARGDLGISYDQEVLRLIDKFNELGIFVGSVVITQYTGQPAADAFRNQLEKNGIDSYLHYPIKGYPTDMDHIISSKGMGKNDYIKTSRNLIVVTAPGPGSGKLATCMSNMYHDQINGIKSGYAKFETFPVWNLPLHHPVNLAYEAATADLDDVNMIDPFHLQTYGETTVNYNRDIEIFPVLKRMLERILGKSPYASPTDMGVNMVGFAITDDEAAVEASKQEIIRRYYQTVLDFKAEKVGEAAVKKIELLMNDLGITPADRKVAVVARQKAEETGGPALAFELPNGEIVTGKNSELFGPTAAALINAIKKSADIAKEVKLIEPEVVKPIQGLKIDHLGSRNPRLHSNEILIALAITATENPDAARAMEELGNLKGSEAHSTIILTDEDKNVLRKLGINVTFDPYYQYDRLYRK

SEQ ID NO: 4781 - protein, 299 aa, Streptococcus pneumoniae
  misc_feature (B) LOCATION 1...299
  hypothetical: YES
ILKIIPLDISIRVPPLHKSILSQKRKKNNYERKFNLLFFAFYFGRIKRRCKMKRLEQIIKLVSEHEKIDVNTLSEKLNVSKVTIRKDLDKLESKGLLHREHGYAVLNSGDDLNVRLSINYEIKRKIVQEAVKLVSDNETIMIESGSTCALLAEEICKQKRNVTIVTNSFFIANFVRAYDSCRIIVLGGEFQKDSQVTVGPLLKEMIQTFHVRQAFVGTDGYDKEMGFTGKDLMRSEVVQYISAASDKVIVLTDSSKFDKRGTVRRFALSQVYEVITDEKLSKQNIATLENAGIMVKVVS

SEQ ID NO: 4782 - protein, 79 aa, Streptococcus pneumoniae
  misc_feature (B) LOCATION 1...79
  hypothetical: YES
PLKIKQIFRIFRLVGTNFSFFFEYMIQIVVRSVKDYSENRKFDAETLEFRKTYSKMKYGRNNVILEFKLNYNNIVEVSF

SEQ ID NO: 4783 - protein, 303 aa, Streptococcus pneumoniae
  misc_feature (B) LOCATION 1...303
  hypothetical: YES
PIKIYRRPDKMAIVSAEKFVQAARDNGYAVGGFNTNNLEWTQAILRAAEAKKAPVLIQTSMGAAKYMGGYKVARNLIANLVESMGITVPVAIHLDHGHYEDALECIEVGYTSIMFDGSHLPVEENLKLAKEVVEKAHAKGISVEAEVGTIGGEEDGIIGKGELAPIEDAKAMVETGIDFLAAGIGNIHGPYPVNWEGLDLDHLQKLTEALPGFPIVLHGGSGIPDEQIQAAIKLGVAKVNVNTECQIAFANATRKFARDYEANEAEYDKKKLFDPRKFLADGVKAIQASVEERIDVFGSEGKA

SEQ ID NO: 4784 - protein, 92 aa, Streptococcus pneumoniae
  misc_feature (B) LOCATION 1...92
  hypothetical: YES
KKKKKKKKKKKKKKKGKKKKEGKKKGGEKKGREGKEEEGGVKEGGGKRRKKRVLREVWGKRGKEKEGKGGGWEGERKEEKGMGVGVGESEKK

SEQ ID NO: 4785 - protein, 295 aa, Streptococcus pneumoniae
  misc_feature (B) LOCATION 1...295
  hypothetical: YES
KAKMNGIINLKKEAGMTSHDAVFKLRKILGTKKIGHGGTLDPDVVGVLPIAVGKATRMVEFMQDEGKIYEGEITLGYSTTTEDASGEVVAETPVLSPLDEKLVDEAIASLTGPITQIPPMYSAVKVNGRKLYEYARAGQEVERPERQVTIYQFERTSPISYDGQLARFTFRVKCSKGTYIRTLSVDLGEKLGYAAHMSHLTRTSAAGLQLEDALSLEEIAEKVEAGQLDFLHPLEIGTGDLVKVFLTPEEATEVRFGRFIELDQTDKELAAFEDDKLLAILEKRGNLYKPRKVFS

SEQ ID NO: 4786 - protein, 90 aa, Streptococcus pneumoniae
  misc_feature (B) LOCATION 1...90
  hypothetical: YES
YKKIQTRILLRKGRFKCYHCSKMEVAETSIVKKNHQIPCIINQKIDQKLIEKTSMTDIDHQLSISTSTVIRKINDFHFEHDFSRLPEIMS

SEQ ID NO: 4787 - protein, 68 aa, Streptococcus pneumoniae
  misc_feature (B) LOCATION 1...68
  hypothetical: YES
VXXXXXXXXXXXXKKXXXXXXXXXXXXGXXGXGGGGGGGXGGGGGGGGGGXGGGGGGGGGXGGXGGGG

SEQ ID NO: 4788 - protein, 108 aa, Streptococcus pneumoniae
  misc_feature (B) LOCATION 1...108
  hypothetical: YES
IKKKKKKKKKKKKNGGKKIKKKKKKKKKKKKKKKGKKKKRGKKEGGGEKGEGGKGGRRRGEGRGGEKKEKKGVEGGMGKKGEGKGGEGGRLGGGKKGRKGNGGGCGGK

SEQ ID NO: 4789 - protein, 333 aa, Streptococcus pneumoniae
  misc_feature (B) LOCATION 1...333
  hypothetical: YES
XXXXXXXXXXXXXTVIFFGLLATNTVFADNSEVWQFVQENGRTYYKKGDLKETYWRVIDGKYYYFDSLSGEMVVGWQYIPFPSKGSTIGPYPNGIRLEGFPKSEWYYFDKNGVLQEFVGWKTLEIKTKDSVGRKYGEKREDSEDKEEKRYYTNYYFNQNHSLETGWLYDQSNWYYLAKTEINGENYLGGERRAGWINDDSTWYYLDPTTGIMQTGWQYLRNKWYYLRSSGAMATGWYQEGTTWYYLDQPNGDMKTGWQNLGNKWYYLRSSGAMVTGWVKDDSTWYYLNAGNGDMKTGWFQVNGRWYYAYSSGALAVNTTVDGYSVNYNGEWVR

SEQ ID NO: 4790 - protein, 67 aa, Streptococcus pneumoniae
  misc_feature (B) LOCATION 1...67
  hypothetical: YES
KKKKKKKKKKKKKKKKKKRKKKKKKKKKKKKKKKKKKKKKKKKKKKFYNKPKTADHVVEEEAHDDWI

SEQ ID NO: 4791 - protein, 471 aa, Streptococcus pneumoniae
  misc_feature (B) LOCATION 1...471
  hypothetical: YES
VKKMTKTLPKDFIFGGATAAYQAEGATHTDGKGPVAWDKYLEDNYWYTAEPASDFYNRYPVDLKLAEEYGVNGIRISIAWSRIFPTGYGQVNAKGVEFYHNLFAECHKRHVEPFVTLHHFDTPEALHSNGDFLNRENIEHFVDYAAFCFEEFPEVNYWTTFNEIGPIGDGQYLVGKFPPGIQYDLAKVFQSHHNMMVSHARAVKLYKEKGYKGEIGVVHALPTKYPLDPENPADVRAAELEDIIHNKFILDATYLGRYSAETMEGVNHILLVNGGSLDLREEDFTALEAAKDLNDFLGINYYMSDWMEAFDGETEIIHNGKGEKGSSKYQIKGVGRRVAPDYVPRTDWDWIIYPQGLYDQIMRVKKDYPNYKKIYITENGLGYKDEFVDNTVYDDGRIDYVKQHLEILSDAIADGANVKGYFIWSLMDVFSWSNGYEKRYGLFYVDFETQERYPKKSAHWYKKVAETQIID

SEQ ID NO: 4792 - protein, 85 aa, Streptococcus pneumoniae
  misc_feature (B) LOCATION 1...85
  hypothetical: YES
KEKIEKLAKKYSDNLNIKVQERVREMANDNKSHYLIYRVLGISFEEGENIDLYQNKGRFLYKYAGSFLEEAAVLSFNEKFGTENT

SEQ ID NO: 4793 - protein, 79 aa, Streptococcus pneumoniae
  misc_feature (B) LOCATION 1...79
  hypothetical: YES
GEKMSYEQEFMKEFEAWVNTQIMINDMAHKESQKVYEEDQDERAKDAMIRYESRLDAYQFLLGKFENFKVGKGFHDLPE

SEQ ID NO: 4794 - protein, 295 aa, Streptococcus pneumoniae
  misc_feature (B) LOCATION 1...295
  hypothetical: YES
KEKMTKKVGVGQAHSKIILIGEHAVVYGYPAISLPLLEVEVTCKVVPAESPWRLYEEDTLSMAVYASLEYLDITEACIRCEIDSAIPEKRGMGSSAAISIAAIRAVFDYYQADLPHDVLEILVNRAEMIAHMNPSGLDAKTCLSDQPIRFIKNVGFTELEMDLSAYLVIADTGVYGHTREAIQVVQNKGKDALPFLHALGELTQQAEVAISQKDAEGLGQILSQAHLHLKEIGVSSPEADFLVETTLSHGALGAKMSGGGLGGCIIALVTNLTHAQELAERLEEKGAVQTWIESL

SEQ ID NO: 4795 - protein, 363 aa, Streptococcus pneumoniae
  misc_feature (B) LOCATION 1...363
  hypothetical: YES
GRKMKTKLPTEWQELSDQLGFQEFTPIQTQLFDPLLTGENLLGVSQTGTGKTLAYLLPSLLRLQKKKAQQLLILAPNTELAGQIFDVCKTWAEAIGLTAQLFLSGSSQKRQIERLKKGPEILIGTPGRIFELIKLKKIKMMNVETIILDEFDQLLDDSQIHFVEKITHYAPRDHQLVYMSATTKFDQEKIVPNTRTIDLSNQKLDNIQHFYMQVDQRHRVDILRKLAHVEDFRGLVFFNSLSDLGNAEEKLQYRDILAVSLASDVNVKFRKVILEKFKDNQLTLLLATDLLARGIDIDSLECVVNFDIPRDSETYTHRAGRTGRMGKEGYVITLVTHPEEIKKLKKFASIREIVLKNQELYIK

SEQ ID NO: 4796 - protein, 219 aa, Streptococcus pneumoniae
  misc_feature (B) LOCATION 1...219
  hypothetical: YES
SMKILIVEDEEMIREGVSDYLTDCGYETIEAADGQEALEQFSSYEVALVLLDIQMPKLNGLEVLAEIRKTSQVPVLMLTAFQDEEYKMSAFASLADGYLEKPFSLSLLKVRVDAIFKRYYDTGRIFSYKDTKVDFESYSASLAGQEVPINAKELEILDYLVKNEGRALTRSQIIDAVWKATDEVPFDRVIDVYIKELRKKLDLDCILTVRNVGYKLERK

SEQ ID NO: 4797 - protein, 175 aa, Streptococcus pneumoniae
  misc_feature (B) LOCATION 1...175
  hypothetical: YES
KMKIAIIGYSGSGKSTLAEKLSNYYSIPKLHMDTLQFQPGWQDSDHEWMLTEIKNFLTKHKAWVIDGNYSWCYYQERMQEADQIIFLNFWPLTCLFRAFKRYLKYRGKVRESMAADCPERFDWEFIRWILWDGRSKTQKENYQKLCQEYSHKVTILRNQRELDQFLDKKRKSYNS

SEQ ID NO: 4798 - protein, 258 aa, Streptococcus pneumoniae
  misc_feature (B) LOCATION 1...258
  hypothetical: YES
IKKIPLQDGVLCYNRDMKTNDIVYGVHAVTEALLANTGNKLYLQEDLRGKNVEKVKELATEKKVSISWTSKKSLSEMTEGAVHQGFVLRVSEFAYSELDYILAKTRQEENPLLLILDGLTDPHNLGSILRTADATNVSGVIIPKHRAVGVTPVVAKTATGAIEHVPIARVTNLNQTLYKLKDEGFWTFGTDMNGTPCYKWNTKGKIALIIGNEGKGISSNIKKQVDEMITIPMNGHVQSLNASVAAAILMYEVFRNRL

SEQ ID NO: 4799 - protein, 110 aa, Streptococcus pneumoniae
  misc_feature (B) LOCATION 1...110
  hypothetical: YES
SEKILQRLEVYKNYQHLYDLRMTILLNLSTLYLYNQDKNMCKQICYTLLEDAKNKKSYDRLAICYVRIGICRDNAKLIQKGFSLLELTEETSMLSHLKKEVEIYYQAKER

SEQ ID NO: 4800 - protein, 206 aa, Streptococcus pneumoniae
  misc_feature (B) LOCATION 1...206
  hypothetical: YES
GEKMSAIERITKAAHLIDMNDIIREGNPTLRAIAEEVTFPLSDQEIILGEKMMQFLKHSQDPVMAEKMGLRGGVGLAAPQLDISKRIIAVLVPNIVEEGETPQEAYDLEAIMYNPKIVSHSVQDAALGEGEGCLSVDRNVPGYVVRHARVTVDYFDKDGEKHRIKLKGYNSIVVQHEIDHINGIMFYDRINEKDPFAVKDGLLILE

SEQ ID NO: 4801 - protein, 183 aa, Streptococcus pneumoniae
  misc_feature (B) LOCATION 1...183
  hypothetical: YES
QEKINMSRIGNKVIVLPAGVELANNDNVVTVKGPKGELTREFSKDIEIRVEGTEVTLHRPNDSKEMKTIHGTTRALLNNMVVGVSEGFKKELEMRGVGYRAQLQGSKLVLAVGKSHPDEVEAPEGITFELPNPTTIVVSGISKEVVGQTAAYVRSLRSPEPYKGKGIRYVGEFVRRKEGKTGK

SEQ ID NO: 4802 - protein, 263 aa, Streptococcus pneumoniae
  misc_feature (B) LOCATION 1...263
  hypothetical: YES
KEKIMPVMKIEYYSQVLDMEWGMNVLYPDANRVREPECEDIPVLYLLHGMSGNHNSWLKRTNVERLLRGTNLIVVMPNTSNGWYTDTQYGFDYYTALAEELPQVLKRFFPNMTSKREKTFIAGLSMGGYGCFKLALATNRFSHAASFSGALSFQNFSPESQNLGSPAYWRGVFGEIRDWTTSPYSLESLAKKSDKKTKLWAWCGEQDFLYEANNLAVKNLKKLGFDVTYSHSAGTHEWYYWEKQLEVFLTTLPIDFKLEERLT

SEQ ID NO: 4803 - protein, 121 aa, Streptococcus pneumoniae
  misc_feature (B) LOCATION 1...121
  hypothetical: YES
RVEIRRRNMTQAERIREYYREHPAASYDEVAEVVGTTNSNVRANLAKDIKAGRCVRLEDKSYDYSPYYNHTQALTELVDWKNDNRREWVDMLTRAAEKETDSNVMRLLIKEANKLMKEVTK

SEQ ID NO: 4804 - protein, 97 aa, Streptococcus pneumoniae
  misc_feature (B) LOCATION 1...97
  hypothetical: YES
MNEICHLFIYSVLKGYSLEGWKKINGSWYYYRQHDKQTGWQEINDTWYYLDSSGKMLTDWQKVNGKWYYLNSNRAMVTGSQTIDGKVYNFASSGEWI

SEQ ID NO: 4805 - protein, 278 aa, Streptococcus pneumoniae
  misc_feature (B) LOCATION 1...278
  hypothetical: YES
EIEMKLRRSDRMVVISNYLINNPYKLTSLNTFAEKYESAKSSISEDIVIIKRAFEEIEIGHIQTVTGAGGGVIFTPSISSQDAKEMVEDLRTKLSESDRILPGGYIYLSDLLSTPAILKNIGRIIAKSFMDQKIDAVMTVATKGVPLANAVANVLNVSFVIVRRDLKITEGSTVSVNYVSGSSGDRIEKMFLSKRSLKAGSRVLIVDDFLKGGGTVNGMISLLREFDSELAGVAVFADNAQEEREKQFDYKSLLKVTNIDVKNQAIDVEVGNIFDEDK

SEQ ID NO: 4806 - protein, 364 aa, Streptococcus pneumoniae
  misc_feature (B) LOCATION 1...364
  hypothetical: YES
GEEMKPSIHSLAHQTMQEWVLEQGEKKFRADQIWEWLYRKRVQSFEEMTNLSKDLIAKLNDQFVVNPLKQGIVQESADGTVKYLFELPDGMLIETVLMRQHYGLSVCVTTQVGCNIGCTFCASGLIKKQRDLNNGEIVAQIMLVQKYFAERGQDERVSHIVVMGIGEPFDNYNNVLNFFRTINDDKGMAIGARHITVSTSGLAHKIRDFADEGVQVNLAVSLHAPNNELRSSIMKINRAFPIEKLFAAIEYYIETTNRGVTFEYIMLNEVNDGVEQALELTELLKNIKKLSYVNLIPYNPVSEHDQYSRSPKERVLAFYDTLKKKGVNCVVRQEHGTDIDAACGQLRSNTMKRDRQKAVAAVNP

SEQ ID NO: 4807 - protein, 72 aa, Streptococcus pneumoniae
  misc_feature (B) LOCATION 1...72
  hypothetical: YES
DREISFFLLISPLVGSSSPTKIFKRVDLPAPFFPTRAIRSRSSTCRLILSKRTSPAKERSILLACKIIIQVV

SEQ ID NO: 4808 - protein, 237 aa, Streptococcus pneumoniae
  misc_feature (B) LOCATION 1...237
  hypothetical: YES
AGEIGRMNKQELIKRIEDLPYTEGPIADTIEINRNWILKSIEQLAESEIGHADEAPRYVKNILARLRELPLHDREFWLKAIMSEFEQDFSHAKWREGYEQGKIEGMVEREKVIVPQCVAEYIEFKKKNNFHVYGAMRVIEDHYDKKVPDWFYENNIEKFCLAWLDGYEVEKEKRYFVKIKGNIKENMLVYGELLKRYFFTKSFSLDDVIYSHTRKELENAKIGWVFDCEGFEIEEVE

SEQ ID NO: 4809 - protein, 325 aa, Streptococcus pneumoniae
  misc_feature (B) LOCATION 1...325
  hypothetical: YES
KGEIMKTSLKLYFTALVASFLLLLGACSTNSSTSQTETSSSAPTEVTIKSSLDEVKLSKVPEKIVTFDLGAADTIRALGFEKNIVGMPTKTVPTYLKDLVGTVKNVGFMKEPDLEAIAALEPDLIIASPRTQKFVDKFKEIAPTVLFQASKDDYWTSTKANIESLASAFGETGTQKAKEELAKLDKSIQEVATKNESSDKKALAILLNEGKMAAFGAKSRFSFLYQTLKFKPTDTTFEDSRHGQEVSFESVKEINPDILFVINRTLAIGGDNSSNNGVLENALIAETPAAKNGKIIQLTPDLWYLSGGGLESTKLMIEDIQKALK

SEQ ID NO: 4810 - protein, 219 aa, Streptococcus pneumoniae
  misc_feature (B) LOCATION 1...219
  hypothetical: YES
EGEIMTLLQLQDVTYRYKNTAEAVLYQIDYNFEPGKFYSIIGESGAGKSTLLSLLAGLDSPVEGSILFQGEDIRKKGYSYHRMHHISLVFQNYNLIDYLSPLENIRLVNKKASKNTLLELGLDESQIKRNVLQLSGGQQQRVAIARSLVSEAPVILADEPTGNLDPKTAGDIVELLKSLAQKTGKCVIVVTHSKEVAQASDITLELKDKKLTETRNTSK

SEQ ID NO: 4811 - protein, 150 aa, Streptococcus pneumoniae
  misc_feature (B) LOCATION 1...150
  hypothetical: YES
YMEIKDILNVSLIQTDLQMQSKEEVFEALAQLLVETGYVSDRDQFIEVLYQREAEGQTGIGNYIAIPHSKSSAVEKAGVVIAINHNEIPWETIDGKGVKVIVLFAVGDDTEAAREHLKTLSLFARKLGNDEVVAKLVRAQTSDDVIAAFC

SEQ ID NO: 4812 - protein, 65 aa, Streptococcus pneumoniae
  misc_feature (B) LOCATION 1...65
  hypothetical: YES
NMEINVSKLRTDLPQVGVQPYRQVHAHSTGNPHSTVQNEADYHWRKDPELGFFSHIVGNGCIMLG

SEQ ID NO: 4813 - protein, 171 aa, Streptococcus pneumoniae
  misc_feature (B) LOCATION 1...171
  hypothetical: YES
HMEISLLTDVGQKRTNNQDYVNHYVNRAGRTMIILADGMGGHRAGNIASEMAVTDLGVAWVDTQIDTVNEVREWFAHYLEIENQKIHQLGQDEAYRGMGTTLEVLAIIDNQAIYAHIGDSRIGLIRGEEYHQLTSDHSLVNELLKAGQLTTRRGRSSSAKKYYHPVYWAKR

SEQ ID NO: 4814 - protein, 63 aa, Streptococcus pneumoniae
  misc_feature (B) LOCATION 1...63
  hypothetical: YES
AMEMMELPSQDILIFTKQIRHWILSEQVISGERKLFFREDTPKEILDMYENIKSKLDCAYQEV

SEQ ID NO: 4815 - protein, 241 aa, Streptococcus pneumoniae
  misc_feature (B) LOCATION 1...241
  hypothetical: YES
SKEIIMTATSLGLSNIEIVVRIVLSVVIGSIIGLERGSKSQPAGIRTYSIVCLAACLIMMTNEYVSYKFGTGDPTRLGAQVISGVGFLGAGTILITDKKKITGLTTAAGIWASAGIGLAIGVGFYEGALLVAISVWGVISMFQPLKKYLQNRSKMIELYIVVKSTEAYNRVLVYCAENGIRMTDSRTAFGDVNSDRIEYFDVPDKKIASFITLELSGRFEHLRLMEEIANIVGVIYVEEIS

SEQ ID NO: 4816 - protein, 443 aa, Streptococcus pneumoniae
  misc_feature (B) LOCATION 1...443
  hypothetical: YES
EKEMLELLKSIDDFAWGPPLLILLVGTGIYLTMRLGLLQVLRLPKAFQLIFIQDKGHGDVSSFAALCTALASTVGTGNIIGVATAIKVGGPGALFWMWMAAFFGMATKYAEGLLAIKYRTKDDHGAVAGGPMHYILLGMGEKWRPLAVLFAVXGVLVALLGIGTFTQVNSITESIQNTTTISPAITALVLSVFVAIAVFGGLKSISKVSTTVVPFMAIIYILGTLTVIFFNIGKIPGTIALVFTSAFSPLAAVGGFAGASVRMAIQNGVARGVFSNESGLGSAHIAAAAAKTNEPVEQGLISMTGTFIDTLIICTLTGLTILVTGVWSGDLNGVALTQSAFSTVFSHFGPALLTIFLVLFAFTTILGWNYYGERCFEFLFGVRFIWLYRVVFVLMVLLGGFIELDMVWIIADIVNALMALPNLIALLVLSPVVIAETKKYFDK

SEQ ID NO: 4817 - protein, 315 aa, Streptococcus pneumoniae
  misc_feature (B) LOCATION 1...315
  hypothetical: YES
RGVFMSYQDLKECKIITAFITPFHEDGSINFDAIPALIEHLLDHHTDGILLAGTTAESPTLTHDEELELFAAVQKIVNGRVPLIAGVGTNDTRDSIEFVKEVAEFGGFAAGLAIVPYYNKPSQEGMYQHFKAIADASDLPIIIYNIPGRVVVELTPETMLRLADHPNIIGVKECTSLANMAYLIEHKPEEFLVYTGEDGDAFHAMNLGADGVISVASHTNGDEMHEMFIAIAESDMKKAAAIQRKFIPKVNALFSYPSPAPVKAVLNYMGFEAGPTRLPLVPAPEEDAKRIIKVVVDGDYEATKATVTGVLRPDY

SEQ ID NO: 4818 - protein, 257 aa, Streptococcus pneumoniae
  misc_feature (B) LOCATION 1...257
  hypothetical: YES
REPLSLGWIHICDSKMSNVDKIRKIHIIVCWMYIFLSFRAIINDTEYFLLIFLAFIYSIVSLPLYSVKNKIVSICLAINSILLMSFPILINKFFPESFLTYTVLISVFILELAIFHLIGEDFATKLTNEYKKISQFRSKVSQSPWIKYLEISSFILTIFPSILYGTVDNHVLTLIFLIKICADTTIKFLFIRLFDTSTLMKRRIFFLFALDVIVYLFLGYLLVIQKAGYLFSVLLLFSNFSVPFIKEKEYELFKNSK

SEQ ID NO: 4819 - protein, 74 aa, Streptococcus pneumoniae
  misc_feature (B) LOCATION 1...74
  hypothetical: YES
SFRIPFTVPISSLRPSGSNILVASSKIKIAGLRATTPAMATRCFWPPDRRAGSLFLKSNMPTKARASSTLFFIS

SEQ ID NO: 4820 - protein, 442 aa, Streptococcus pneumoniae
  misc_feature (B) LOCATION 1...442
  hypothetical: YES
SMRIGLFTDTYFPQVSGVATSIRTLKTELEKQGHAVFIFTTTDKDVNRYEDWQIIRIPSVPFFAFKDRRFAYRGFSKALEIAKQYQLDIIHTQTEFSLGLLGIWIARELKIPVIHTYHTQYEDYVHYIAKGMLIRPSMVKYLVRGFLHDVDGVICPSEIVRDLLSDYKVKVEKRVIPTGIELAKFERPEIKQENLKELRSKLGIQDGEKTLLSLSRISYEKNIQAVLVAFADVLKEEDKVKLVVAGDGPYLNDLKEQAQNLEIQDSVIFTGMIAPSETALYYKAADFFISASTSETQGLTYLESLASGTPVIAHGNPYLNNLISDKMFGTLYYGEHDLAGAILEALIATPDMNEHTLSEKLYEISAENFGKRVHEFYLDAIISNNFQKDLAKDDTVSQRIFKTVLYLPQQVVAVPVKGSRRMLKASKTQLISMRDYWKDHEE

SEQ ID NO: 4821 - protein, 69 aa, Streptococcus pneumoniae
  misc_feature (B) LOCATION 1...69
  hypothetical: YES
LKPLLHADETSYRVLESDSQLTYYWTFLSGKAENQAITLYHHDQRRSGLVVQEFLGDYSGYVHCDMLRQ

SEQ ID NO: 4822 - protein, 378 aa, Streptococcus pneumoniae
  misc_feature (B) LOCATION 1...378
  hypothetical: YES
LFRMRENMKIVIAPDSFKESLTAQQVAEAIKRGFQQSIADVECLLCPVGDGGEGTVDAIRHSLDLKEKWIQVTDPSGQKEAMRYFQKGELALFEVADLVGLGKIPLEKRNPLQIQTCGIGELILHLISKGIKDIYIGVGGTASNDGGLGIAAGLGYQFYDRDGNVLPASGQSLLNLASVSTENRYKIPEGVQIHILADVVSPLCGHQGATYTFGNQKGLHPTMFAVVDQAIQDFYEKFSPATLEIKGAGAGGGLAGGLCAFAQASIVSGIDTCLDLINFDKKVSDADLVVVGEGRLDSQSFAGKAPIGVAIRTPVGVPVIAICGSLAEDLPPLPFENIQAVFSILEKSEPLEDSLKNASLYLERTAANIGHLLNMCKI

SEQ ID NO: 4823 - protein, 422 aa, Streptococcus pneumoniae
  misc_feature (B) LOCATION 1...422
  hypothetical: YES
KLRMRKIVINGGLPLQGEITISGAKNSVVALIPAIILADDVVTLDCVPDISDVASLVEIMELMGATVKRYDDVLEIDPRGVQNIPMPYGKINSLRASYYFYGSLLGRFGEATVGLPGGCDLGPRPIDLHLKAFEAMGATASYEGDNMKLSAKDTGLHGASIYMDTVSVGATINTMIAAVKANGRTIIENAAREPEIIDVATLLNNMGAHIRGAGTNIIIIDGVERLHGTRHQVIPDRIEAGTYISLAAAVGKGIRINNVLYEHLEGFIAKLEEMGVRMTVSEDSIFVEEQSNLKAINIKTAPYPGFATDLQQPLTPLLLRANGRGTIVDTIYEKRVNHVFELAKMDADISTTNGHILYTGGRDLRGASVKATDLRAGAALVIVGLMAEGKTEITNIEFILRGYSDIIEKLRNLGADIRLVED

SEQ ID NO: 4824 - protein, 272 aa, Streptococcus pneumoniae
  misc_feature (B) LOCATION 1...272
  hypothetical: YES
KTRMSEIGFKYSILASGSSGNSFYLETSKKKLLVDAGLSGKKITSLLAEINRKPEDLDAILITHEHSDHIHGVGVLARKYGMDLYANEKTWQAMENSKYLGKVDSSQKHIFEMGKTKTFGDIDIESFGVSHDAVAPQFYRFMKDDKSFVLLTDTGYVSDRMAGIVENADGYLIEANHDVEILRSGSYAWRLKQRILSDLGHLSNEDGAEAMIRTLGNRTKKIYLGHLSKENNIKELAHMTMVNQLAQADLGVGVDFKVYDTSPDTATPLTEI

SEQ ID NO: 4825 - protein, 391 aa, Streptococcus pneumoniae
  misc_feature (B) LOCATION 1...391
  hypothetical: YES
ENRMAKKPKKLEEISKKFGAEREKALNDALKLIEKDFGKGSIMRLGERAEQKVQVMSSGSLALDIALGSGGYPKGRIIEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLGASINKTKTIAIFINQLREKVGVMFGNPETTPGGRALKFYASVRLDVRGNTQIKGTGDQKETNVGKETKIKVVKNKVAPPFKEAVVEIMYGEGISKTGELLKIASDLDIIKKAGAWYSYKDEKIGQGSENAKKYLAEHPEIFDEIDKQVRSKFGLIDGEEVSEQDTENKKDEPKKEEAVNEEVTLDLGDELEIEIEE

SEQ ID NO: 4826 - protein, 271 aa, Streptococcus pneumoniae
  misc_feature (B) LOCATION 1...271
  hypothetical: YES
KDRMMQALTNPFPIGSSSLIHCMTNEISCEMLANGILALGCKPVMADDPREVLDFTKQSQALFINLGHLSAEKEKAIRMAALYANQSSLPMVVDAVGVTTSSIRKSLVKDLLDYRPTVLKGNMSEIRSLVGLKHHGVGVDASAKDQETEDLLQVLKDWCQTYPGMPFLVTGPKDLIVSENQVAVLENGCTELDWITGTGDLVGALTAVFLSQGKTGFEASCLAVSYLNIAAEKIVVQGMGLEEFRYQVLNQLSLLRRDENWLDTIKGEVYE

SEQ ID NO: 4827 - protein, 245 aa, Streptococcus pneumoniae
  misc_feature (B) LOCATION 1...245
  hypothetical: YES
GQRMIEYKNVALRYTEKDVLRDVNLQIEDGEFMVLVGPSGSGKTTMLKMINRLLEPTDGNIYMDGKRIKDYDERELRLSTGYVLQAIALFPNLTVAENIALIPEMKGWSKEEITKKTEELLAKVGLPVAEYGHRLPSELSGGEQQRVGIVRAMIGQPKILLMDEPFSALDAISRKQLQVLTKELHKEFGMTTIFVTHDTDEALKLADRIAVLQDGEIRQVSNPETILKAPATDFVADLFGGSIHD

SEQ ID NO: 4828 - protein, 120 aa, Streptococcus pneumoniae
  misc_feature (B) LOCATION 1...120
  hypothetical: YES
NKRIYNDFQASKMNLNIYTSPLLAFVFVFIGEFVAYTLYGISLLALIGLARNFGEAGQNLASYLQTLHQSLTDKTSDFRLILGLLAFGFILNTVFRWTRKVEKRPIRTLGFYREISSAIF

SEQ ID NO: 4829 - protein, 297 aa, Streptococcus pneumoniae
  misc_feature (B) LOCATION 1...297
  hypothetical: YES
VGRIIRSGVKMEHLGKVFREFRTSGNYSLKEAAGESCSTSQLSRFELGESDLAVSRFFEILDNIHVTIENFMDKARNFHNHEHVSMMAQIIPLYYSNDIAGFQKLQREQLEKSKSSTTPLYFELNWILLQGLICQRDASYDMKQDDLDKVADYLFKTEEWTMYELILFGNLYSFYDVDYVTRIGREVMEREEFYQEISRHKRLVLILALNCYQHCLEHSSFYNANYFEAYTEKIIDKGIKLYERNVFHYLKGFALYQKGQCKEGCKQMQEAIHIFDVLGLPEQVAYYQEHYEKFVKS

SEQ ID NO: 4830 - protein, 96 aa, Streptococcus pneumoniae
  misc_feature (B) LOCATION 1...96
  hypothetical: YES
PMRIMGLDVGSKTVGVAISDPLGFTAQGLEIIQINEEQGQFGSDRVKELVDTYKVERFVVGLPKNMNNTSGPRVEASQAYGAKLEEFFGLPVDYQE

SEQ ID NO: 4831 - protein, 66 aa, Streptococcus pneumoniae
  misc_feature (B) LOCATION 1...66
  hypothetical: YES
NARMKALCIFLLNMLAWTVLAMIIRGGLDGFDRHTWSTILIASLFGVYDYKPIDKNRKKSKRKKKK

SEQ ID NO: 4832 - protein, 190 aa, Streptococcus pneumoniae
  misc_feature (B) LOCATION 1...190
  hypothetical: YES
EQRMTKRCSWVKMTNPLYIAYHDEEWGQPLHDDQALFELLCMETYQAGLSWETVLNKRQAFREAFHSYQIHSVAEMTDTELEAMLENPAIIRNRAKIFATRANAQAFLQLQAEYGSFDAYLWSFVEGKIVVNDVPDYRQAPAKTPLSEKLAKDLKKRGFKFTGPVAVLSFLQAAGLVDDHENDCEWKGLK

SEQ ID NO: 4833 - protein, 290 aa, Streptococcus pneumoniae
  misc_feature (B) LOCATION 1...290
  hypothetical: YES
EERIKKLAKRISRKEWGMILLAILFTCFSVYLELEVPTYISKITDLLGSQETNLDELWQPASMMMGMSFLAFLSVVAVGFFASRVAASYTSRLRSDIFNRVLDYSQTEIKKFSIPSLLTRTTNDITQVQMLITMGLQVVTRGSIMAIWAIGKILGHSEYWLWAVLVVVIVNVLMTTVLMTLAFPKQSLIQGLTDKLNSITRESLTGIRVVRAYNAEDYQNEKFAAVNDELTRLNLFVNRLMAILNPIMMGISSGLSVAIYWIGAYVINDAAPIARLPLFSDMIVFMSYAM

SEQ ID NO: 4834 - protein, 94 aa, Streptococcus pneumoniae
  misc_feature (B) LOCATION 1...94
  hypothetical: YES
KRRMRNMALTAGIVGLPNVGKSTLFNAITKAGAEAANYPFATIDPNVGMVEDPDERLQKLTEMITPKKTVPTTFEFTDIAGIVKGAFKRRRARE

SEQ ID NO: 4835 - protein, 354 aa, Streptococcus pneumoniae
  misc_feature (B) LOCATION 1...354
  hypothetical: YES
TRRITMVELGISTFGEITELEGTGQTYSHAERIRQLVAEIELADKVGLDVYGIGEHHRADFAVSAPEIVLAAGAVNTKKIRLTSAVSILSSMDPIRLFQQYATIDALSNGRSEIMAGRGSFTESFPLFGYDLKDYDSLFDEKLDLLQLVNEKTKLDWQGRLTQTIAGKEVYPRPVQDKLPMWIATGGHVESTVKIAQAGLPIVYAIIGGNPRYFKKLIQAYREIGSEAGHADKDLKVGAHSWGWIAEDGEQAVKDYFHPTKQVVDAISKDRPHWQELRYEQYLEQVGPNGAMFVGNPDQVAEKLIRMIEDLGLDRFMLHLPLGSMPHDQVLRAIELFGTQVAPKVRAYFAMKEA

SEQ ID NO: 4836 - protein, 249 aa, Streptococcus pneumoniae
  misc_feature (B) LOCATION 1...249
  hypothetical: YES
KRRMNMKKKRRLLFLMSIVLGGFLGMFVGMFKARVESHEIILDVKALMPWISAICLLIGFISMFLTFNFLKKSRKFHSLYQEEMDDDLNETYYVQMYRNLEFGTIAFNITGVAIPLAIFISLSEVIILHTNPQTFFLSFLLFVVFLVAQKSLFKTIAIVRQFDLEFFATPKDVLNYINSYDEGERQANLEQSFRILFQLHQYVLPALYIFLIIISFLTGEIQLLAFLLVGAIHVYINVMQLPMVKRYFK

SEQ ID NO: 4837 - protein, 134 aa, Streptococcus pneumoniae
  misc_feature (B) LOCATION 1...134
  hypothetical: YES
KRRILMGKLSSILLGTVSGAALALFLTSDKGKQVCSQAQDFLDDLREDPEYAKEQVCEKLTEVKEQATDFVLKTKEQVESGEITVDSILAQAKSYAFQATEASKNQLNNLKEQWQEKAEALDDSEEIVIDITEE

SEQ ID NO: 4838 - protein, 280 aa, Streptococcus pneumoniae
  misc_feature (B) LOCATION 1...280
  hypothetical: YES
AMGIALENVNFTYQEGTPLASAALSDVSLTIEDGSYTALIGHTGSGKSTILQLLNGLLVPSQGSVRVFDTLITSTSKNKDIRQIRKQVGLVFQFAENQIFEETVLKDVAFGPQNFGVSEEDAVKTAREKLALVGIDESLFDRSPFELSGGQMRRVAIAGILAMEPAILVLDEPTAGLDPLGRKELMTLFKKLHQSGMTIVLVTHLMDDVAEYANQVYVMEKGRLVKGGKPSDVFQDVVFMEEVQLGVPKITAFCKRLADRGVSFKRLPVKIEEFKESLNG

SEQ ID NO: 4839 - protein, 101 aa, Streptococcus pneumoniae
  misc_feature (B) LOCATION 1...101
  hypothetical: YES
VSTLRSYSPGGVLNALATALNPGKGLTPSTHRLQRGLPGYLILFAPHAFEPQRQLQAREPLSPPVFLHISTHFTATHGIPLSPLALKLNSFQSLLWLSHSL

SEQ ID NO: 4840 - protein, 164 aa, Streptococcus pneumoniae
  misc_feature (B) LOCATION 1...164
  hypothetical: YES
YTLISKTLLEIRLNSLIDLRMFYFISLYFRLENKESHKSQEIGNLIRVYNRSKREEAESEPLNLYVEDEKGNLLAGLIAETFGNWLELEIEYLFVKEELRGQGIGSKLLQQAESEAKNRNCCFAFVNTYQFQAPDFYQKHGYKEVFSLQDYLYIRQRYYYQKNL

SEQ ID NO: 4841 - protein, 100 aa, Streptococcus pneumoniae
  misc_feature (B) LOCATION 1...100
  hypothetical: YES
FFLIINIFLPRFFCHTLLLVFFYFSYYNINMNMKITLIPERCIACGLCQTYSDLFDYHDNGIVRFYDDPDQLEKEISPSQDVLEAVKNCPTRALIGNQEA

SEQ ID NO: 4842 - protein, 83 aa, Streptococcus pneumoniae
  misc_feature (B) LOCATION 1...83
  hypothetical: YES
QGLMEVQASSNLKEFLSKQNHQAKISSTDEVQVLFLKKTPKIISLVKEWNPTIDLIGFKLLVDVTEDHLVDIARKILSRIKQI

SEQ ID NO: 4843 - protein, 1080 aa, Streptococcus pneumoniae
  misc_feature (B) LOCATION 1...1080
  hypothetical: YES
FLLILQYVYWSVYMQTKTKKLIVSLSSLVLSGFLLNHYMTVGAEETTTNTIQQSQKEVQYQQRDTKNLVENGDFGQTEDGSSPWTGSKAQGWSTWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTARLDDWNGIIAGNQYYDSKNEQMAKLNQELEGKVADSLSSISSQADRTYLWEKFSNYKMSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 4844 - protein, 87 aa, Streptococcus pneumoniae
  misc_feature (B) LOCATION 1...87
  hypothetical: YES
FQLIIRNTTTVQIIPIMNGITNLYVCISNDIIADTIADTNADNNTEVTKFLTASSFLTQLSCSANIISLYLAKYSIGILSIKSFDVL

SEQ ID NO: 4845 - protein, 471 aa, Streptococcus pneumoniae
  misc_feature (B) LOCATION 1...471
  hypothetical: YES
RELMMKYLEGEEITNEELKAGIRKATINVEFFPVLCGSAFKNKGVQLMLDAVIDYLPSPLDIPAIKGINPDTDAEETRPASDEEPFAALAFKIMTDPFVGRLTFFRVYSGVLQSGSYVLNTSKGKRERIGRILQMHANSRQEIDTVYSGDIAAAVGLKDTTTGDSLTDEKSKIILESINVPEPVIQLMVEPKSKADQDKMGIALQKLAEEDPTFRVETNVETGETVISGMGELHLDVLVDRMRREFKVEANVGAPQVSYRETFRASTQARGFFKRQSGGKGQFGDVWIEFTPNEEGKGFEFENAIVGGVVPREFIPAVEKGLVESMANGVLAGYPMVDVKAKLYDGSYHDVDSSETAFKIAASLSLKEAAKSAQPAILEPMMLVTITVPEENLGDVMGHVTARRGRVDGMEAHGNSQIVRAYVPLAEMFGYATVLRSASQGRGTFMMVFDHYEDVPKSVQEEIIKKNKGED

SEQ ID NO: 4846 - protein, 202 aa, Streptococcus pneumoniae
  misc_feature (B) LOCATION 1...202
  hypothetical: YES
TQLMSISQNQNVTLTNHCFFQSRTYSQSLDVVQLLQDVSTVVSLKSTTKTILLVSKKKTSNPLFPGVEMFRKQLDEGLAGDNVGVLLRGVQRDEIERGQVIAKPGSINPHTKFKGEVYILTKEEGGRHTPFFNNYRPQFYFRTTDVTGSIELPAGTEMVMPGDNVTIDVELIHPIAVEQGTTFSIREGGRTVGSGMVTEIEA

SEQ ID NO: 4847 - protein, 1169 aa, Streptococcus pneumoniae
  misc_feature (B) LOCATION 1...1169
  hypothetical: YES
MVTLLDLFSENDQIKKWHQNLTDKKRQLILGLSTSTKALAIASSLEKEDRIVLLMSTYGEAEGLVSDLISILGEELVYPFLVDDAPMVEFLMSSQEKIISRVEALRFLTDSSKKGILVCNIAASRLILPSPNAFKDSIVKISVGEEYDQHAFIHQLKENGYRKVTQVQTQGEFSLRGDILDIFEISQLEPCRIEFFGDEIDGIRSFEVETQLSKENKTELTIFPASDMLLREKDYQRGQSALEKQISKTLSPILKSYLEEILSSFHQKQSHADSRKFLSLCYDKTWTVFDYIEKDTPIFFDDYQKLMNQYEVFERELAQYFTEELQNSKAFSDMQYFSDIEQIYKKQSPVTFFSNLQKGLGNLKFDKIYQFNQYPMQEFFNQFSFLKEEIERYKKMDYTIILQSSNSMGSKTLEDMLEEYQIKLDSRDKTNICKESVNLIEGNLRHGFHFVDEKILLITEHEIFQKKLKRRFRRQHVSNAERLKDYNELEKGDYVVHHIHGIGQYLGIETIEIKGIHRDYVSVQYQNGDQISIPVEQIHLLSKYISSDGKAPKLNKLNDGHFKKAKQKVKNQVEDIADDLIKLYSERSQLKGFAFSADDDDQDAFDDAFPYVETDDQLRSIEEIKRDMQASQPMDRLLVGDVGFGKTEVAMRAAFKAVNDHKQVVILVPTTVLAQQHYTNFKERFQNFAVNIDVLSRFRSKKEQTATLEKLKNGQVDILIGTHRVLSKDVVFADLGLMIIDEEQRFGVKHKETLKELKKQVDVLTLTATPIPRTLHMSMLGIRDLSVIETPPTNRYPVQTYVLEKNDSVIRDAVLREMERGGQVYYLYNKVDTIVQKVSELQELIPEASIGYVHGRMSEVQLENTLLDFIEGQYDILVTTTIIETGVDIPNANTLFIENADHMGLSTLYQLRGRVGRSNRIAYAYLMYRPEKSISEVSEKRLEAIKGFTELGSGFKIAMRDLSIRGAGNLLGKSQSGFIDSVGFELYSQLLEEAIAKRNGNANANTRTKGNAELILQIDAYLPDTYISDQRHKIEIYKKIRQIDNRVNYEELQEELIDRFGEYPDVVAYLLEIGLVKSYLDKVFVQRVERKDNKITIQFEKVTQRLFLAQDYFKALSVTNLKAGIAENKGLMELVFDVQNKKDYEILEGLLIFGESLLEIKESKEENSI

SEQ ID NO: 4848 - protein, 145 aa, Streptococcus pneumoniae
  misc_feature (B) LOCATION 1...145
  hypothetical: YES
TKLIVTCSERGRYMIKIYTVSSCTSCKKAKTWLNAHQLSYKEQNLGKEGITREELLDILTKTDNGIASIVSSKNRYAKALGVDIEDLSVNEVLNLIMETPRILKSPILVDEKRLQVGYKEDDIRTFLPRSVRNVENAEARLRAAL

SEQ ID NO: 4849 - protein, 77 aa, Streptococcus pneumoniae
  misc_feature (B) LOCATION 1...77
  hypothetical: YES
KSMIHIIVNTFIEKDMTGAVVEVLYASADQDKVQAKYEELAAQYPENYLAIYDVPLDTDLNTLDHYPSVFIEKEEFE

SEQ ID NO: 4850 - protein, 147 aa, Streptococcus pneumoniae
  misc_feature (B) LOCATION 1...147
  hypothetical: YES
TPMIEIKRIQQQPDLAQAIYAVMAAVYLVSPWTLEQIQADLSQDQTWYALAYDGAEVIGFLAVQENLFEAEVLQIAVKGAYQGQGIASALFAQLPTDKEIFLEVRKSNQRAQAFYKKEKMAVIADRKAYYHDPVEDAIIMKREIDEG

SEQ ID NO: 4851 - protein, 176 aa, Streptococcus pneumoniae
  misc_feature (B) LOCATION 1...176
  hypothetical: YES
IDMMSEVQRAARILYMLRVNFNGLYRVNSKNQFNVPYGRYKNPKIVDEELISAISVYLNNNQLEIKVGDFEKAIVDVRTGDFVYFDPPYIPLSETSAFTSYTHEGFSFADQVRLRDAFKRLSDTGAYVMLSNSSSALVEELYKDFNIHYVEATRTNGAKSSSRGKISEIIVTNYEK

SEQ ID NO: 4852 - protein, 221 aa, Streptococcus pneumoniae
  misc_feature (B) LOCATION 1...221
  hypothetical: YES
ISMIDFYFFLVGSILASFLGLVIDRFPEQSIISSASHCDSCQTRLRPLDLIPILSQVFNRFRCRYCKVRYPVWYALFELVLGLLFLLYSWELLSLGQVVLITAGLTLGIYDFHHQEYPLLVWMTFHLILIASSGWNLVMVSFLALGILAHFIDIRMGAGDFLFLASCALVFSVTELLILIQFASATGILAFLLQKKKERLPFVPFLLLATCLIIFGKLLLV

SEQ ID NO: 4853 - protein, 247 aa, Streptococcus pneumoniae
  misc_feature (B) LOCATION 1...247
  hypothetical: YES
NKMILKKEITMKPETFYNLLAEQNLPLSNQQKEQFERYFELLVEWNEKINLTAITDKEEVYLKHFYDSIAPILQGLIPNETIKLLDIGAGAGFPSLPMKILYPELDVTIIDSLNKRINFLQLLAQELDLNGVHFYHGRAEDFAQDKNFRAQYDFVTARAVARMQVLSELTIPYLKVGGKLLALKASNAPEELLEAKNALNLLFSKVEDNLRYALPNRDPRYITVVEKKKETPNKYPRKAGMPNKRPL

SEQ ID NO: 4854 - protein, 337 aa, Streptococcus pneumoniae
  misc_feature (B) LOCATION 1...337
  hypothetical: YES
VKMIAVKTCGKLYWAGEYAILEPGQLALIKDIPIYMRAEIAFSDSYRIYSDMFDFAVDLRPNPDYSLIQETIALMGDFLAVRGQNLRPFSLKICGKMEREGKKFGLGSSGSVVVLVVKALLALYNLSVDQNLLFKLTSAVLLKRGDNGSMGDLACIVAEDLVLYQSFDRQKVAAWLEEENLATVLERDWGFFISQVKPTLECDFLVGWTKEVAVSSHMVQQIKQNINQNFLSSSKETVVSLVEALEQGKAEKVIEQVEVASKLLEGLSTDIYTPLLRQLKEASQDLQAVAKSSGAGGGDCGIALSFDAQSTETLKNRWADLGIELLYQERIGHDDKS

SEQ ID NO: 4855 - protein, 243 aa, Streptococcus pneumoniae
  misc_feature (B) LOCATION 1...243
  hypothetical: YES
EKMIMSIYKLYKDIERKTMSPAKKAMAKNDYFAFYVGRPLSYLLTVPFLKTNITPNQVSYLSIAPLILGFLTMTFTTNFILLLLAWFLFFLWNLLDGVDGNLARYREQYSKDGSVVDAMAGYVAMVLTYFGAGIVATHLNGSDMYVILGALSGISLIFPRLVMHKYINTVARNESVNNIKDKSNFSTIKLLALNMTSITGIPQVLLLVTILTNQWEFFTLVYFTINFLLMIFSLYSLFKKENV

SEQ ID NO: 4856 - protein, 227 aa, Streptococcus pneumoniae
  misc_feature (B) LOCATION 1...227
  hypothetical: YES
EKMISKRLELVASFVSQGAILLDVGSDHAYLPIELVERGQIKSAIAGEVVEGPYQSAVKNVEAHGLKEKIQVRLANGLAAFEETDQVSVITIAGMGGRLIARILEEGLGKLANVERLILQPNNREDDLRIWLQDHGFQIVAESILEEAGKFYEILVVEAGQMKLSASDVRFGPFLSKEVSPVFVQKWQKEAEKLEFALGQIPEKNLEERQVLVDKIQAIKEVLHVSK

SEQ ID NO: 4857 - protein, 67 aa, Streptococcus pneumoniae
  misc_feature (B) LOCATION 1...67
  hypothetical: YES
LMVMIKLLKLYKKDPLLGKINAIKNGAVAVIPDNTPLAASCTPAPLSINYTIEEYLNLLGNACKNAK

SEQ ID NO: 4858 - protein, 67 aa, Streptococcus pneumoniae
  misc_feature (B) LOCATION 1...67
  hypothetical: YES
LEVMKMATDKNRIMISLDDKNLEKLENLVEDARDRRGMRLTKSQVIELLLNTVDYFDDIMGAIYSKK

SEQ ID NO: 4859 - protein, 1102 aa, Streptococcus pneumoniae
  misc_feature (B) LOCATION 1...1102
  hypothetical: YES
YRVMKNSNEAEMKLLYTDIRTSLTEILTREAEELVAAGKRVFYIAPNSLSFEKERAVLEYLSQQASFSITVTRFAQMARYLVLNDLPAKTTLDDIGLGLAFYKCLAELDPKDLRVYGAIKQDPQLIQQLIELYHEMTKSQMSFLDLENLTDEDKRADLLLIFEKVTAYLNQGQLAQGSQLSHLIEAIENDKVSSDFNQIALVIDGFTRFSAEEERVVDLLHGKGVEIVIGAYASKKAYTSPFSEGNLYQASVKFLHHLASKYQTPAQDCSQTHEKMDSFDKASRLLESSYDFSELALDVDEKDRENLQIWSCLTQKEELELVARSIRQKLHENSDLSYKHFRILLGDVASYQLSLKTIFDQYQIPFYLGRSEAMAHHPLTQFVESILALKRYRFRQEDLINLLRTDLYTDLSQSDIDAFEQYIRYLGINGLPAFQQTFTKSHHGKFNLERLNVLRLRILAPLETLFASRKQKAENLLQKWSVFLKEGAVTKQLQDLTTTLEAVEQERQTEVWKAFCHVLEQFATVFAGSQVSLEDFLALLHSGMSLSQYRTIPATVDTVLVQSYDLIAPLTADFVYAIGLTQDNLPKISQNTSLLTDEERQNLNQTTEEGVQLLIASSENLKKNRYTMLSLVNSARKQLFLSAPSLFNESESKESAYLQELIHFGFRRREKRMNHKGLSKEDMGSYHSLLSSLVAYHQQGEMSDTEQDLTFVKVLSRVIGKKLDLQGLENPAIPTSPSSKTLTKDTLQALYPAKQEFYLSTSGLTEFYLNEYSYFLRYVLGLQEELRLRPDARSHGNFLHRIFERALQLPNEDSFDQRLEQAIQETSQEREFEAIYQESLEAQFTKEVLLDVARTTGHILRHNPAIETIKEEANFGGKDQAFIQLDNGRSVFVRGKVDRIDRLKANGAIGVVDYKSSLTQFQFPHFFNGLNSQLPTYLAALKREGEQNFFGAMYLEMAEPIQSLMAVKSLAGAVVEASKSMKYQGLFLEKESSYLGEFYNKNKANQLTDEEFQLLLDYNAYLYKKAAEKILAGRFAINPYTENGRSIAPYVQQHQAITGFEANYHLGQARFLEKLDLADGKRLVGEKLKQAWFEKIREELNR

SEQ ID NO: 4860 - protein, 288 aa, Streptococcus pneumoniae
  misc_feature (B) LOCATION 1...288
  hypothetical: YES
NDTIERIMNNMTDLKAIQACSLEMAEYFVAFCKEHDLLCYLCGGGAIGALRNKGFIPWDDDLDFFMPRKDYEKLAELWPRYADERYFLSKSYKDFVDRNLFITIRDKETTCIKPYQQDLDLPHGLALDVLPLDYYPKDPAERKKQVRWALIYSLFCAQTIPEKHGALMKWGSRILLGLTPKSLRYRIWKKAEKEMTKYDLADCDGITELCSGPGYMRNKYPITSFEDNLFLPFEGTKMPIPIGYDVYLRTAFGDYMTPPPADKQVPHHDVVIADMDKSYTEYKGEYGG

SEQ ID NO: 4861 - protein, 404 aa, Streptococcus pneumoniae
  misc_feature (B) LOCATION 1...404
  hypothetical: YES
YRTIFYMNDKTEVNMTIGIDKIGFATSQYVLKLQDLAEARGIDPEKLSKGLLLKELSIAPLTEDIVTLAASASDSILTEQERQEVDMVIVATESGIDQSKAAAVFVHGLLGIQPFARSFEIKEACYGATAALHYAKLHVENSPESKVLVIASDIAKYGIETPGEPTQGAGSVAMLITQNPRMMAFNNDNVAQTRDIMDFWRPNYSTTPHVNGVYSTQQYLDSLKTTWLEYQKRYQLTLDDFAAVCFHLPYPKLALKGLKKIMDKSLPQEKKDLLQKHFDQSILYSQKVGNIYTGSLFLGLLSLLENTDSLKAGDKIALYSYGSGAVAEFFSGELVEGYEAYLDKDRLNKLNQRTALSVADYEKVFFEEVNLDETNSAQFAGYENQDFALVEILDHQRRYSKVEK

SEQ ID NO: 4862 - protein, 317 aa, Streptococcus pneumoniae
  misc_feature (B) LOCATION 1...317
  hypothetical: YES
LLAIVTVNNILVASNFSPRLEIKRISLYNKYLYRKHLLERYLCFHIHFPFFHVFGWYRKPLSKRFELNWFQLLFTSIFLISLSMVPIAIQNSSQETYPLETFIDNVYEPLTDKVVQDLSEHATIVDGTLTYTGTVSQASSIVIGPSQIKELPKDLQLHFDTNELVISKESKELTRISYRAIQTESFKSKDSLTQAISKDWYQQNRVYISLFLVLGASFLFGLNFFIVSLGASLLLYITKKSRLFSFRTFKECYHFILNCLGLPTLITLILGLFGQNMTTLITVQNILFVLYLVTIFYKTHFRDPNYHKYGDFYARYD

SEQ ID NO: 4863 - protein, 68 aa, Streptococcus pneumoniae
  misc_feature (B) LOCATION 1...68
  hypothetical: YES
KSAFFSTKIRLSINSYSFISALAIFPNSLEVVILNPATFPRQFRKHLLVHLVLYRVKRSGGPFQPESF

SEQ ID NO: 4864 - protein, 448 aa, Streptococcus pneumoniae
  misc_feature (B) LOCATION 1...448
  hypothetical: YES
VCQMKSWKNWLIKINYCVYKKKRKGRMRKFLIILLLPSFLTISKVVSTEKEVVYTSKEIYYLSQSDFGIYFREKLSSPMVYGEVPVYANEDLVVESGKLTPKTSFQITEWRLNKQGIPVFKLSNHQFIAADKRFLYDQSEVTPTIKKVWLESDFKLYNSPYDLKEVKSSLSAYSQVSIDKTMFVEGREFLHIDQAGWVAKESTSEEDNRMSKVQEMLSEKYQKDSFSIYVKQLTTGKEAGINQDEKMYAASVLKLSYLYYTQEKINEGLYQLDTTVKYVSAVNDFPGSYKPEGSGSLPKKEDNKEYSLKDLITKVSKESDNVAHNLLGYYISNQSDATFKSKMSAIMGDDWDPKEKLISSKMAGKFMEAIYNQNGFVLESLTKTDFDSQRIAKGVSVKVAHKIGDADEFKHDTGVVYADSPFILSIFTKNSDYDTISKIAKDVYEVLK

SEQ ID NO: 4865 - protein, 295 aa, Streptococcus pneumoniae
  misc_feature (B) LOCATION 1...295
  hypothetical: YES
RCQMAVSLNDIKTKIASTKNTSQITNAMQMVSAAKLGRSEEAARNFQVYAQKVRKLLTDILHGNGAGASTNPMLISRSVKKTGYIVITSDRGLVGGYNSSILKAVMELKEEYHPDGKGFEMICIGGMGADFFKARGIQPLYELRGLADQPSFDQVRKIISKTVEMYQNELFDELYVCYNHHVNTLTSQMRVEQMLPIVDLDPNEADEEYSLTFELETSREEILEQLLPQFAESMIYGAIIDAKTAENAAGMTAMQTATDNAKKVINDLTIQYNRARQAAITQEITEIVAGASALE

SEQ ID NO: 4866 - protein, 302 aa, Streptococcus pneumoniae
  misc_feature (B) LOCATION 1...302
  hypothetical: YES
VTKMLFDQIASNKRKTWILLLVFFLLLALVGYAVGYLFIRSGLGGLVIALIIGFIYALSMIFQSTEIVMSMNGAREVDEQTAPDLYHVVEDMALVAQIPMPRVFIIDDPALNAFATGSNPQNAAVAATSGLLAIMNREELEAVMGHEVSHIRNYDIRISTIAVALASAITMLSGMAGRMMWWGGAGRRRSDDDRDGNGLEIIMLVVSLLAIVLAPLAATLVQLAISRQREFLADASSVELTRNPQGMINALDKLDNSKPMSRHVDDASSALYINDPKKGGGFQKLFYTHPPISERIERLKQM

SEQ ID NO: 4867 - protein, 217 aa, Streptococcus pneumoniae
  misc_feature (B) LOCATION 1...217
  hypothetical: YES
ENKMAFIEKGQEIDMEVIKAETQLSAEALRLKESRDRELADIISGEDDRILLVIGPCSSDNEEAVLEYARRLSALQKKVADKIFMVMRVYTAKPRTNGDGYKGLVHQPDTSKAPSLINGLQAVRQLHYRVITETGLTTADEMLYPSNLILVDDLVSYHAVGARSVEDQEHRFVASGIDAPVGMKNPTSGNLGVMFNAIYAAQNKQTSLIMGRKLEHQ

SEQ ID NO: 4868 - protein, 292 aa, Streptococcus pneumoniae
  misc_feature (B) LOCATION 1...292
  hypothetical: YES
ENKMKIIVPATSANIGPGFDSVGVAVTKYLQIEVCEERDEWLIEHQIGKWIPHDERNLLLKIALQIVPDLQPRRLKMTSDVPLARGLGSSSSVIVAGIELANQLGQLNLSDHEKLQLATKIEGHPDNVAPAIYGNLVIASSVEGQVSAIVADFPECDFLAYIPNYELRTRDSRSVLPKKLSYKEAVAASSIANVAVAALLAGDMVTAGQAIEGDLFHERYRQDLVREFAMIKQVTKENGAYATYLSGAGPTVMVLASHDKMPTIKAELEKQPFKGKLHDLRVDTQGVRVEAK

SEQ ID NO: 4869 - protein, 411 aa, Streptococcus pneumoniae
  misc_feature (B) LOCATION 1...411
  hypothetical: YES
KSKIGAFMQYSEIMIRYGELSTKGKNRMRFINKLRNNISDVLSIYPQVKVTADRDRAHAYLNGADYTAVAESLKQVFGIQNFSPVYKVEKSVEVLKSAVQEIMQDIYKEGMTFKISSKRSDHTFELDSRELNQTLGRAVFEAIPNVQAQMKSPDINLQVEIREEAAYLSYETVRGAGGLPVGTSGKGMLMLSGGIDSPVAGYLALKRGVDIEAVHFASPPYTSPGALKKAQDLTRKLTKFGGNIQFIEVPFTEIQEEIKAKAPEAYLMTLTRRFMMRITDRIREVRNGLVIINGESLGQVASQTLESMKAINAVTNTPIIRPVVTMDKLEIIDIAQEIDTFDISIQPFEDCCTIFAPDRPKTNPKIKNAEQYEARMDVEGLVERAVAGIMITEITPQAEKDEVDDLIDNLL

SEQ ID NO: 4870 - protein, 166 aa, Streptococcus pneumoniae
  misc_feature (B) LOCATION 1...166
  hypothetical: YES
GGKIMKYDLYDNCIELLKEREVTIEDMAALVIFSQQKYYPELTLDDASYAIQRVLKKREVQNVIMTGIELDKLAEAQKLSPEFQKIMEKDNPLYGIDEVIVLSILNLYGSIAFTNYGYLDKLKPLILERLNENHEGVCNVFLDDIVGAIAAAACSKIAHNHASDEI

SEQ ID NO: 4871 - protein, 73 aa, Streptococcus pneumoniae
  misc_feature (B) LOCATION 1...73
  hypothetical: YES
RLKMSKQKKFEENLAELETIVQSLENGEIALEDAITAFQKGMVLSKELQATLDKAEKTLVKVMQEDGTESDFE

SEQ ID NO: 4872 - protein, 596 aa, Streptococcus pneumoniae
  misc_feature (B) LOCATION 1...596
  hypothetical: YES
CQKIQGIRACKRCLTLRMNGGFQMKEFYKKRFALTDGGARNLSKATLASFFVYCINMLPAILLMIFAQEVLENMGKSNGFYIVFSVLILIAMYILLSIEYDKLYNTTYQESADLRIRTAENLSKLPLSYFSKHDISDISQTIMADIEGIEHAMSHSIPKVGGMVLFFPLISVMMLAGNVKMGLAVIIPSILSFIFIPLSKKYQVNGQNRYYDVLRKNSESFQENIEMQMEIKAYNLSKDIKDDLYKKMEDSEKVHLKAEVTTILTLSISSIFSFISLAVVIFVGVNLIINKEINSLYLIGYLLAAMKIKDSLDASKEGLMEIFYLSPKIERLKEIQNQDLQEGDDYSLKKFDIDLKDVEFAYNKDEKVLNGVSFKAKQGEVTALVGASGCGKTTILKLISRLYDYDKGQILIDGKDIKEISTESLFDKVSIVFQDVVLFNQSVMENIRIGKQDASDEEVKRAAKLANCTDFIEKMDKGFDTVIGENGAELSGGERQRLSIARAFLKDAPILILDEITASLDVNNEKKIQESLNNLVKDKTVVIISHRMKSIENADKIVVLQNGRVESEGKHEELLQKSKIYKNLIEKTKMAEEFIY

SEQ ID NO: 4873 - protein, 86 aa, Streptococcus pneumoniae
  misc_feature (B) LOCATION 1...86
  hypothetical: YES
VKKMFKDFIQSIYEKVYIINFEKCSQIPCLTSEELKSLGKWYVSTGKEWICHSDADLEEFKNLFLNFINPEEWDTISFDSDFMPFQ

SEQ ID NO: 4874 - protein, 294 aa, Streptococcus pneumoniae
  misc_feature (B) LOCATION 1...294
  hypothetical: YES
EKKMRNVRVATIQMQCAKDVATNIQTAERLVRQAAEQGAQIILLPELFEHPYFCQERQYDYYQYAQSVAENTAIQHFKVIAKELQVVLPISFYEKDGNVLYNSIAVIDADGEVLGVYRKTHIPDDHYYQEKFYFTPGNTGFKVWNTRYAKIGIGICWDQWFPETARCLALNGAELLFYPTAIGSEPILDTDSCGHWQRTMQGHAAANIVPVIAANRYGLEEVTPSEENGGQSSSLDFYGSSFMTDETGAILERAERQEEAVLLATYDLDKGASERLNWGLFRDRRPEMYRQITD

SEQ ID NO: 4875 - protein, 255 aa, Streptococcus pneumoniae
  misc_feature (B) LOCATION 1...255
  hypothetical: YES
NRKIDTMTKIKIVTDSSVTIEPELVKQLDITIVPLSVMIDNVVYSDADLKEEGKFLQLMQESKNLPKTSQPPVGVFAEIFEDLCKDGGQILAIHMSHALSGTVEAARQGASLSTADVTVVDSSFTDQALKFQVVEAAKLAQEGKDMEAILSHVEEVKNHTELYIGVSTLENLVKGGRISRVTGLLSSLLNIRVVMQMKDHELQPMVKGRGTKTFKKWLDELITSLSERAVAEIGISYSGSDRLGKRDERKLTSLC

SEQ ID NO: 4876 - protein, 192 aa, Streptococcus pneumoniae
  misc_feature (B) LOCATION 1...192
  hypothetical: YES
RGKMSTLAKIEALLFVAGEDGIRVRQLAELLSLPPTGIQQSLGKLAQKYEKDPDSSLALIETSGAYRLVTKPQFAEILKEYSKAPINQSLSRAALETLSIIAYKQPITRIEIDAIRGVNSSGALAKLQAFDLIKEDGKKEVLGRPNLYVTTDYFLDYMGINHLEELPVIDELEIQAQESQLFGERIEEDENQ

SEQ ID NO: 4877 - protein, 264 aa, Streptococcus pneumoniae
  misc_feature (B) LOCATION 1...264
  hypothetical: YES
FMKIPLLTFARHKFVYVLLTLLFLALVYRDVLMTYFFFDIHAPDLAKFDGQAIKNDLLKSALDFRILQFNLGFYQSFIIPIIIVLLGFQYIELKNKVLRLSIGREVSYQGLKRKLTLQVASIPCLIYLVTVLIIAIITYFLGTFSPLGWNSLFSDGSGLQRLLDGEIKSYLFFTCVLLIGIFINAIYFLQIVDYVGNVTRSAITYLMFLWLGSMLLYSALPYYMVPMTSLMQASYGDVSLMKLFTPYILYIVPYMVLEKYEDNV

SEQ ID NO: 4878 - protein, 240 aa, Streptococcus pneumoniae
  misc_feature (B) LOCATION 1...240
  hypothetical: YES
TMKIDILTLFPEMFSPLEHSIVGKAREKGLLDIQYHNFRENAEKARHVDDEPYGGGQGMLLRAQPIFDSFDAIEKKNPRVILLDPAGKQFDQAYAEDLAQEEELIFICGHYEGYDERIKTLVTDEISLGDYVLTGGELAAMTMIDATVRLIPEVIGKESSHQDDSFSSGLLEYHQYTRPYDYRGMVVPDVLMSGHHEKIRQWRLYESLKKTYERRPDLLEHYQLTVEEEKMLAEIKENKE

SEQ ID NO: 4879 - protein, 74 aa, Streptococcus pneumoniae
  misc_feature (B) LOCATION 1...74
  hypothetical: YES
KMKIMLLNIHERSTIILSRGKKFIRFLTCFKGDKMENLLDVIEQFLSLSDEKLEELADKNQLLRLQEEKERKNA

SEQ ID NO: 4880 - protein, 266 aa, Streptococcus pneumoniae
  misc_feature (B) LOCATION 1...266
  hypothetical: YES
EMKIGFIGLGNMGASLAKSVLQTRTSDEILLANRSQAKVDAFIADFGGQASSNEKMFAEADVIFLGVKPAQFSELLSQYQTILEKRESLLLISMAAGLTLEKLASLIPSQHRIIRMMPNTPASIGQGVISYALSPNCRAEDSEIFCQLLAKAGLLVELGESLINAATGLAGCGPAFVYLFIEALADAGVQTGLPRETALKMAAQTVVGAGQLVLESQQHPGVLKDQVCSPGGSTIAGVASLEAHAFRGTVMEAVHQAYKRTQELGK

SEQ ID NO: 4881 - protein, 65 aa, Streptococcus pneumoniae
  misc_feature (B) LOCATION 1...65
  hypothetical: YES
LDEIGFQGASAPSRKVLLASGTTKSVSTSSLMPKPSHSLQEPKGALKEKRRGSNSGTVKPQTGQA

SEQ ID NO: 4882 - protein, 179 aa, Streptococcus pneumoniae
  misc_feature (B) LOCATION 1...179
  hypothetical: YES
KVEIMSYFKKYKFDKSQFKLGMRTFKTGIAVFLVLLIFGFFGWKGLQIGALTAVFSLRESFDESVHFGTSRILGNSIGGLYALVFFLLNTFFHEAFWVTLVVVPICTMLTIMTNVAMNNKAGVIGGVAAMLIITLSIPSGETILYVFVRVLETFMGVFVAIIVNYDIDRIRLFLEKKEK

SEQ ID NO: 4883 - protein, 1967 aa, Streptococcus pneumoniae
  misc_feature (B) LOCATION 1...1967
  hypothetical: YES
IKEIKVFKKDRFSIRKIKGVVGSVFLGSLLMAPSVVDAATYHYVNKEIISQEAKDLIQTGKPDRNEVVYGLVYQKDQLPQTGTEASVLTAFGLLTVGSLLLIYKRKKIASVFLVGAMGLVVLPSAGAVDPVATLALASREGVVEMEGYRYVGYLSGDILKTLGLDTVLEKTSAKPGEVTVVEVETPQSTTNQEQARTENQVVETEEAPKTEESPKEEPKSEIKPTDDTLPKVEKGKKIXXTAPVEEVGGEVESKPEEKVAVKPESQPSDKPAEESKVEPPVEQAKGPEQPVQPTQAEQPRIPKDSSQPEDPKEDRGAEDTPKQEDTQPEVVETKDEAANQPVEEPKVETPAVEKQTEPKVEQVGEPVEPSEDEKAPVSPEKQPEAPEEKAVEETPKPEDKIKGIGTKEPVDKSELNNQIDKASSVSPTDYSTASYNALGPVLETAKGVYASEPVKQPEVNSETNKLKTAIDALNVDKSELQEQLRVAEQKQQADYSAKTWREFKIAELQAKEINNQTTPLPKQSEIDAATKALQDALQALAVDKTVLQNAINTANSKREEEYTAQTWKALEDALTAVNPVNEDETATQSKVDEATRNLEEAINNLVLLTEKPVLTFIETDKKALEREVVAKYSLENQNKTKIKSITATLKKGETVVSTVELIGDDVTNETITSAFKNLEYYKEYTLSTTMVYDRGDGDVTEILDNQPIQLDLKKVELKNIKRTDLIKYENGKETNESLITTVPDDKRNYYLKITSKNQKTTLLAVKNIEETTVNGTPVYKVTAIADNLVSRTADNKFEEEYVHYIEKPKVHEDNVYYNFKELVEAIQNDPSKEYRLGQSMSARNVVPNGKSYITKEFTGKLLSSEGKQFAITELEHPLFNVITNATINNVNFENVEIERSGQDNIASLANTMKGSSVITNVKITGTLSGRNNVAGFVNNMNDGTRIENVAFFGKLHSTSGNGSHTGGIAGTNYRGIVRKAYVDATITGNKTRASLLVPKVDYGLTLDHLIGTKALLTESVVKGKIDVSNPVEVGAIASKTWPVGTVSNSVSYAKIIRGEELFGSNDVDDSDYASAHIKDLYAVEGYSSGNRSFRKSKTFTKLTKEQADAKVTTFNITADKLESDLSPLAKLNEEKAYSSIQDYNAEYNQAYKNLEKLIPFYNKDYIVYQGNKLNKEHHLNTKEVLSVTAMNNNEFITNLDEANKIIVHYADGTKDYFNLSSSSEGLSNVKEYTITDLGIKYTPNIVQKDNTTLVNDIKSILESVELQSQTMYQHLNRLGDYRVNAIKDLYLEESFTDVKENLTNLITKLVQNEEHQLNDSPAARQMIRDKVEKNKAALLLGLTYLNRYYGVKFGDVNIKELMLFKPDFYGEKVSVLDRLIEIGSKENNIKGSRTFDAFGQVLAKYTKSGNLDAFLNYNRQLFTNIDNMNDWFIDATEDHVYIAERASEVEEIKNSKHRAFDNLKRSHLRNTILPLLNIDKAHLYLISNYNAIAFGSAERLGKKSLEDIKDIVNKAADGYRNYYDFWYRLASDNVKQRLLRDAVIPIWEGYNAPGGWVEKYGRYNTDKVYTPLREFFGPMDKYYNYNGTGAYAAIYPNSDDIRTDVKYVHLEMVGEYGISVYTHETTHVNDRAIYLGGFGHREGTDAEAYAQGMLQTPVTGSGFDEFGSLGINMVFKRKNDGNQWYITDPKTLKTREDINRYMKGYNDTLTLLDEIEAESVISQQNKDLNSAWFKKIDREYRDNNKLNQWDKIRNLSQEEKNELNIQSVNDLVDQQLMTNRNPGNGIYKPEAISYNDQSPYVGVRMMTGIYGGNTSKGAPGAVSFKHNAFRLWGYYGYENGFLGYASNKYKQQSKTDGESVLSDEYIIKKISNNTFNTIEEFKKAYFKEVKDKATKGLTTFEVNGSSVSSYDDLLTLFKEAVKKDAETLKQEANGNKTVSMNNTVKLKEAVYKKLLQQTDSFKTSIFK

SEQ ID NO: 4884 - protein, 471 aa, Streptococcus pneumoniae
  misc_feature (B) LOCATION 1...471
  hypothetical: YES
EKEMSSGKIAQVIGPVVDVLFAAGEKLPEINNALVVYKNDERKTKIVLEVALELGDGMVRTIAMESTDGLTRGMEVLDTGRPISVPVGKETLGRVFNVLGDTIDLEAPFTEDAERQPIHKKAPTFDELSTSSEILETGIKVIDLLAPYLKGGKVGLFGGAGVGKTVLIQELIHNIAQEHGGISVFAGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLDSTTNLERKLVQLGIYPAVDPLASSSRALAPEIVGEEHYAVAAEVKRVLQRYHELQDIIAILGMDELSDEEKTLVARARRIQFFLSQNFNVAEQFTGQPGSYVPVAETVRGFKEILDGKYDHLPEDAFRGVGSIEDVIAKAEKMGF

SEQ ID NO: 4885 - protein, 285 aa, Streptococcus pneumoniae
  misc_feature (B) LOCATION 1...285
  hypothetical: YES
NEEMDMTKIALLSDIHGNTTALEAVLADAQQLGVDEYWLLGDILMPGTGRRRILDLLDQLPITARVLGNWEDSLWHGVRKELDSTRPSQRYLLRQCQYVLEEISLEEIEVLHNQPLQIHRQFGDLTVGISHHLPDKNWGRELIHTGKQEEFDRLVTHPPCDIAVYGHIHQQLLRYGTGGQLIVNPGSIGQPFFLDAQLRKDLRAQYMILEFDDKGLVDMDFRRVDYDVAAELQLAKDLRLPYFEVYYESLVNGIHHTHHQEFLRELAQKEGCDRELDDWLKSGND

SEQ ID NO: 4886 - protein, 153 aa, Streptococcus pneumoniae
  misc_feature (B) LOCATION 1...153
  hypothetical: YES
KGEIMGKPMLVFKRFGHQIHLMVQKEAKRCGIEFMGGPQGQVVHFLDNREKNQDLVLIKDIDQELNITKSVASNLVKRIVQNCLVELEASPVDKRAKFVRLTDKARSQMQQVKAFFERIDKQLMEDIDEDELLIFEKVLGQLQAKYQGNRRRE

SEQ ID NO: 4887 - protein, 326 aa, Streptococcus pneumoniae
  misc_feature (B) LOCATION 1...326
  hypothetical: YES
DLWIILNSEETCHYWKRPRQTGGRGVVSTCSYEARAFGVHSAMSSKEAYERCPQAVFISGNYEKYKSVGLRIRAIFKRYTDLIEPMSIDEAYLDVTENKLGIKSAVKIARLIQKDIWKELHLTASAGVSYNKFLAKMASDYQKPHGLTVILPEQAEDFLKQMDISKFHGVGKKTVERLHQMGVFTGADLLEVPEVTLIDRFGRLGYDLYRKARGIHNSPVKSNRIRKSIGKEKTYGKILRAEEDIKKELTLLSEKVALNLHQQEKAGKIVILKIRYEDFSTLTKRKSLAQKTQDASQISQIALQLYEELSEKERGVRLLGITLTGF

SEQ ID NO: 4888 - protein, 73 aa, Streptococcus pneumoniae
  misc_feature (B) LOCATION 1...73
  hypothetical: YES
RKWIWPPQAGQVYACFSSLSSNTFTNSPLVSLATNMNSLLFYIIRKKEKRSGKFLIFMCVYLIFLASKVAKRS

SEQ ID NO: 4889 - protein, 118 aa, Streptococcus pneumoniae
  misc_feature (B) LOCATION 1...118
  hypothetical: YES
TPWIRLRSCRPTPLPPFRRCARSRSPSNRPCPRTDRRRPGHRSTRATKRQRPKSPPRTATRRPRRLSPTSPRRLPPTGRRPIGKPPCQLPRKQRQRQRQRQRQRQRQRQRQQCCRPDR

SEQ ID NO: 4890 - protein, 119 aa, Streptococcus pneumoniae
  misc_feature (B) LOCATION 1...119
  hypothetical: YES
RTWISTAGWLSAAVEKTCDLDVGIVVLRSISFVNTPPIVSIPSDNGVTSRRTTSLTSPVITPPWIAAPIATTSSGFTDLFGSLPVSALTASTTAGIRVEPPTRITSSISDKLKPASERA

SEQ ID NO: 4891 - protein, 93 aa, Streptococcus pneumoniae
  misc_feature (B) LOCATION 1...93
  hypothetical: YES
LEWISTSALFTLASKVTIPLLPPEISSCSKAFLVPCSQTNKSAPWSLSACFSKYLSRSVEADSSAPSMIKLILTGKSSWCCIYFLKALKRAVI

SEQ ID NO: 4892 - protein, 292 aa, Streptococcus pneumoniae
  misc_feature (B) LOCATION 1...292
  hypothetical: YES
RWWIRILRILSVASTERSSRMIKLWRRYKPFINAGVQELITYRVNFILYRIGDVMGAFVAFYLWKAVFDSSQESLIQGFSMADITLYIIMSFVTNLLTRSDSSFMIGEEVKDGSIIMRLLRPVHFAASYLFTELGSKWLIFISVGLPFLSVIVLMKIISGQGIVEVLGLTVLYLFSLTLAYLINFFFNICFGFSAFVFKNLWGSNLLKTSIVAFMSGSLIPLAFFPKVVSDILSFLPFSSLIYTPVMIIVGKYDASQILQALLLQFFWLLVMVGLSQLIWKRVQSFITIQGG

SEQ ID NO: 4893 - protein, 67 aa, Streptococcus pneumoniae
  misc_feature (B) LOCATION 1...67
  hypothetical: YES
ACRIAQLRSTNSCNSIISILIKKCDILERTSQRGSTFIYVPQKRGTPLIGSNVATVLCFHKKLKSSI

SEQ ID NO: 4894 - protein, 70 aa, Streptococcus pneumoniae
  misc_feature (B) LOCATION 1...70
  hypothetical: YES
KTRILYSMKIKEQTRKLAAGCSKHCFEVVDRTDEVSSKHGFEVVDETDEVSNHTYGKVKLTWFEDILEEY

SEQ ID NO: 4895 - protein, 346 aa, Streptococcus pneumoniae
  misc_feature (B) LOCATION 1...346
  hypothetical: YES
CWRIYKMKLFKKMMQVVLATFFFGLLGTSTVCADDSEGWQFVQKNGRTYYKKGDLKETYWRVIDGKYYYFDPLSGEMVVGWQYIPAPHKGVTIGPSPRQEIAFRPDWFYFGQDGVLQEFVGKQVLEAKTATNTNKHHGEEYDSPAEKRVYYFEDQRSYHTLKTGWVYDDGDWYYLQKDGGFDSRINRLTVGELARGWVKDYPLTYDEEKLKPAPWYYLDPATGIMQTGWQHLGNKWYYLRSSGAMATGWYQDGSTWYYLDAENGDMKTGWQNLGNKWYYLRSSGAMATGWYQEGSTWYYLNASNGDMKTGWFQVNGNWYYAYDSGALAVNTTVGGYYLNYNGEWVK

SEQ ID NO: 4896 - protein, 218 aa, Streptococcus pneumoniae
  misc_feature (B) LOCATION 1...218
  hypothetical: YES
KEGMTSMRKKTIGEVLRLDRINQGLSLDELQKKTEIQLDMLEAMEADDFDQLPSPFYTRSFLKKYAWAVELDDQIVLDAYDSGSMITYEEVDVDEDELTGRRRSNKKKKKKTSFLPLFYFILFALSILIFVTYYVWNYIQTQPEEPSLSNYSVVQSTSSTSSVPHSSSSSSSSIESAISVSGEGNHVEIAYKTSKETVKLQLAVSDVSKLGQCFRKRT

SEQ ID NO: 4897 - protein, 246 aa, Streptococcus pneumoniae
  misc_feature (B) LOCATION 1...246
  hypothetical: YES
SRGIMELFKTWKKNMVLYGLKSQIGTVYRNNDRTTSFYDVGNFLYLAGELDSRFWEDFVRKYGLDYKIIISENTNWQDFLHRKVGLNSFTRYSFKDKANFQVEFLNNLVTHLEEGYNIVPIDNHIYNCFSTEEWSQDLQGDFESYQDFVLKGGFGFVILKNNELIAGISSGLVYRKAVEVEVATRPNEQGNGFAKKLGAAMILESLNRDMFPLWDAHNEASKKVAEFLGYELSEPYEAFELEEILI

SEQ ID NO: 4898 - protein, 483 aa, Streptococcus pneumoniae
  misc_feature (B) LOCATION 1...483
  hypothetical: YES
NVGIIIKLIKDEERRKMEAVLAIDLGATSGRAIVGYLSENKLVMEEINRFSNLPIRVKGHLSWDIDFLLAKILESIRLANTSYKILSIGIDTWGVDFGLIDNEGKLLLQPVHYRDERTKGVLKEISEMTELEKLYSETGNQIMEINTLFQLFKARQESPDSFYKTNKILLMPDLFNYLLTGKFATEKSIASTTQLFDPRSQNWNQNILKLFELDSSLLPEIVSEGNVLGRIKEEYGLGDIPVVNVCSHDTASAIVSVPKTEGSLFISSGTWSLVGVELTSPILTTESFSYGFTNEVGKDGVITFLKNCTGLWIIEELRRSFERRGKAYSFDDIRTMVEKEKENLPLIDTESTEFATESDMHKTLTEYLAYHHETREWTDGQLFKIVYESLAETYRKAIELLEELTHKVYKRIYVIGGGARASYFNQMIADRTGKEVLTGSTEGTAVGNIVVQLLSQGKINEDTELKDIMTNIADTQYYYPQLS

SEQ ID NO: 4899 - protein, 65 aa, Streptococcus pneumoniae
  misc_feature (B) LOCATION 1...65
  hypothetical: YES
EKGIKIMRGRKRRRNLDYVLVQAEATAIVRCVGSGISKEFPKKREVIRPQPAKGSYARADKTSWG

SEQ ID NO: 4900 - protein, 250 aa, Streptococcus pneumoniae
  misc_feature (B) LOCATION 1...250
  hypothetical: YES
MKVLILEDVIEHQVRLERILDEISKESNIPISYKTTGKVREFEEYIENDEVNQLYFLDIDIHGIEKKGFEVAQLIRHYNPYAIIVFITSRSEFATLTYKYQVSALDFVDKDINDEMFKKRIEQNIFYTKSMLLENEDVVDYFDYNYKGNDLKIPYHDILYIETTGVSHKLRIIGKNFAKEFYGTMTDIQEKDKHTQRFYSPHKSFLVNIGNIREIDRKNLEIVFYEDHRCPISRLKIRKLKDILEKKSQK

SEQ ID NO: 4901 - protein, 364 aa, Streptococcus pneumoniae
  misc_feature (B) LOCATION 1...364
  hypothetical: YES
YTYLWRKYMKREILLERIDKLKQLMPWYVLEYYQSKLAVPYSFTTLYEYLKEYDRFFSWVLESGISNADKISDIPLSVLENMSKKDMESFILYLRERPLLNANTTKQGVSQTTINRTLSALSSLYKYLTEEVENDQGEPYFYRNVMKKVSTKKKKETLAARAENIKQKLFLGDETEGFLTYIDQEHPQQLSNRALSSFNKNKERDLAIIALLLASGVRLSEAVNLDLRDLNLKMMVINVTRKGGKRDSVNVAAFAKPYLENYLAIRNQRYKTEKTDTALFLTLYRGVPNRIDASSVEKMVAKYSEDFKVRVTPHKLRHTLATRLYDATKSQVLVSHQLGHASTQVTDLYTHIVNDEQKNALDSL

SEQ ID NO: 4902 - protein, 401 aa, Streptococcus pneumoniae
  misc_feature (B) LOCATION 1...401
  hypothetical: YES
NDYLSFQSIFVNRISFLLYALSSPLFKVYFFGGSEMSDSKYMKLAIKLAQKGAGYVNPNPMVGAIIVKDNHIIGQGYHEFFGGPHAERNALKNCRKSPVGATLYVTLEPCCHFGKTPPCIDAIIDSGITRVVIGSLDCNPIVSGKGVKILEENNLQVTVGILENECLNLIKSFRKYITQHVPYVFMKYAMSMDGKIATKTNQSKWITEEEARKHVHQLRHHVSAIMVGVNTVIQDDPLLTCRLEEGKNPIRIICDTHLRTPLTSKIVKTANDIKTYIATSSEDKNKMKLYQNHGCEILSIKKKGNHIDLSSLMQHLGNMQIDSLVLEGGSLMNWSALEQQIVDELKIYIAPKIFGGSAKFPVGGEGISLPNDAIRLKPYAFSQIGNDYLIESEVIYPCSQE

SEQ ID NO: 4903 - protein, 134 aa, Streptococcus pneumoniae
  misc_feature (B) LOCATION 1...134
  hypothetical: YES
WSYLKKDVKQPLAVNQLQLSAAFTPGFESAFHVNMEDSQAAMRDGSIFEYCKLHDVVIQAWSVLQFGYFKGNFVGNEKFQALNQVLDRLAIKYGVTSSTIAISWILRYPAKMQAVVGTTNPKHLREVSQAQTLA

SEQ ID NO: 4904 - protein, 87 aa, Streptococcus pneumoniae
  misc_feature (B) LOCATION 1...87
  hypothetical: YES
IFYFFCQGLSDSFFMDLFQELICLAQKTFYFFLAICRRLLVAIYHVLLKQESYNPRLQGLTEIRNPDKTMFVQDAIRFAQQHGFNML

SEQ ID NO: 4905 - protein, 273 aa, Streptococcus pneumoniae
  misc_feature (B) LOCATION 1...273
  hypothetical: YES
VQYFIDKGVQGLYVNGSSGECIYQSVEDRKLILEEVMAVAKGKLTIIAHVACNNTKDSMELARHAESLGVDAIATIPPIYFRLPEYSVAKYWNDISSAAPNTDYVIYNIPQLAGVALTPSLYTEMLKNPRVIGVKNSSMPVQDIQTFVSLGGEDHIVFNGPDEQFLGGRLMGARAGIGGTYGAMPELFLKLNQLIADKDLETARELQYAINAIIGKLTSVHGNMYGVIKEVLKINEGLTIGSVRSPLTPVTEEDRPVVEEAAALIRETKERFL

SEQ ID NO: 4906 - protein, 480 aa, Streptococcus pneumoniae
  misc_feature (B) LOCATION 1...480
  hypothetical: YES
IRYFSRRIRFLWKLWEKEKIGWGIEMNGKLVKPSLAIVQSFLVILLAYLLSTVRETEIVSTTAIVLYILHYFAFYISDYGQDFFKRGYLIELVQTLKYILFFALAISISNFFLEDRFSISRRGMIYFLLLHVLLVYVLNRFIKWYWKRAYPNFKGSKKILLLTATSRVEKVLDRLIESDDVVGELVAVSVLDKPDFQHDYLKVVAEGEIVNFATHEVVDEVFINLPSEKYNIGELVSQFETMGVDVTVNLNAFDCILAHNKQICEMAGLNVVTFSTTFYKTSHVIAKRVIDIIGSLVGLILCGLVSIVLVPLIRKDGGSAIFAQTRIGKNGRHFTFYKFRSMCVDAEEKKRELMEQNTMQGGMFKVDEDPRITKIGHFIRKTSLDELPQFYNVLKGDMSLVGTRPPTVDEYEHYTPEQKRRLSFKPGITGLWQVSGRSEIKNFDEVVKLDVAYIDGWTIWKDIEILLKTVKVVLMKDGAK

SEQ ID NO: 4907 - protein, 71 aa, Streptococcus pneumoniae
  misc_feature (B) LOCATION 1...71
  hypothetical: YES
RMYFVIAEFNANWFTHRNSKRSYFLHHIKFKFFYNLTSTYQKHARNIFTDFDLSHNIFYHLTSLYLWLSYY

SEQ ID NO: 4908 - protein, 70 aa, Streptococcus pneumoniae
  misc_feature (B) LOCATION 1...70
  hypothetical: YES
ETHFISLFFVTTVDGNLRGYPTTKVKICKASKDFLENPSLLFGVKIDQANTVFQVTKTSLYAPSTGVEIF

SEQ ID NO: 4909 - protein, 70 aa, Streptococcus pneumoniae; identical to SEQ ID NO: 4908
  misc_feature (B) LOCATION 1...70
  hypothetical: YES

SEQ ID NO: 4910 - protein, 70 aa, Streptococcus pneumoniae; identical to SEQ ID NO: 4908
  misc_feature (B) LOCATION 1...70
  hypothetical: YES

SEQ ID NO: 4911 - protein, 302 aa, Streptococcus pneumoniae
  misc_feature (B) LOCATION 1...302
  hypothetical: YES
QTHLKGKDSKMQGQIIKALAGFYYVESDGQVYQTRARGNFRKKGHTPYVGDWVDFSAEENSEGYILKIHERKNSLVRPPIVNIDQAVVIMSVKEPDFNSNLLDRFLVLLEHKGIHPIVYISKMDLLEDRGELDFYQQTYGDIGYDFVTSKEELLSLLTGKVTVFMGQTGVGKSTLLNKIAPDLNLETGEISDSLGRGRHTTRAVSFYNLNGGKIADTPGFSSLDYEVSRAEDLNQAFPEIATVSRDCKFRTCTHTHEPSCAVKPAVEEGVIATFRFDNYLQFLSEIENRRETYKKVSKKIPK

SEQ ID NO: 4912 - protein, 69 aa, Streptococcus pneumoniae
  misc_feature (B) LOCATION 1...69
  hypothetical: YES
KYNLYSLKISSNHVSFALLYIWLLTSSVLSTTSKQCFELTSSVLSTTSKQCFELTAASFLVCSLIFIEY

SEQ ID NO: 4913 - protein, 275 aa, Streptococcus pneumoniae
  misc_feature (B) LOCATION 1...275
  hypothetical: YES
PSNFLEEMMKLLFILISMVLVSLYMVITSVDHREEILFGNYPSVDVTGMMINQPVASREEVTEALSHLAVEHNSLIARRIVEPNEAGETRFTYATYGEGKLPEGLTISSKESAETSDLLGSYLIVSGSLDGVSLQTTLKELGYQGFVSNGEDPFSIVLLLTATPMVLLSLAIFLLTFMSLTLIYRIKSLRQAGIRLIXGESLFGVALRPVLEDVRQLICSVLVSSLLGLGILWYQGALFMATVQLVIIALLLYGLHLGRDFYLTKCRLSTWFTGK

SEQ ID NO: 4914 - protein, 210 aa, Streptococcus pneumoniae
  misc_feature (B) LOCATION 1...210
  hypothetical: YES
FSNFCGDKGPIVSDDVYFASTLRRGVPAAEAGMDRVQADYTGMLGTVMNALVMADSLQQVGVDTRVQTAIAMQQVAEPYVRGRALRHLEKGRIVIFGAGIGSPYFSTDTTAALRAAEIEADAILMAKNGVDGVYNADPKKDKTAVKFEELTHRDVINKGLRIMDSTASTLSMDNDIDLVVFNMNQSGNIKRVVFGENIGTTVSNNIEEKE

SEQ ID NO: 4915 - protein, 219 aa, Streptococcus pneumoniae
  misc_feature (B) LOCATION 1...219
  hypothetical: YES
MKNFTNIKFKENGEFNHFPGNTVVANLYTKQDLMEVVDIIQSRYRELPFIDKFTLTPRNSIHMTVIELLCHENRETEFWSSNLPLDTPLQEIHDYFAKQLEIFPLLDEEIHMRITEMGKQNILVEPADEASAKRLEEIRTYVSEKAGVCFPNHDRYQFHISIGYLRIPLTEEEEEEFTKVRAELTEILLEKIPTITVNRIDYTVFEDMRQFVPYHEKFK

SEQ ID NO: 4916 - protein, 336 aa, Streptococcus pneumoniae
  misc_feature (B) LOCATION 1...336
  hypothetical: YES
IHFVTNLMRNFPVVSDGPFTPEDYVGRINYELANDFGNLLNRTFSMINKYFDGQIPAYVEGVTEFDHVLAEVAEQSIADFHTHMEAVDYPRALEAVWTLISRTNKYIDETAPWVLAKDEALRDQLASVMSHLAASIRVVAHLIEPFMMETSRAVLTQLGLEEVSSLENLSLADFPADVTVVAKGTPIFPRLNMEEEIAYIKEQMEGNKPAVEKEWNPDEVELKLNKDEIKFEDFDKVEIRVAEVKEVSKVEGSDKLLQFCLDAGDGEDRQILSGIAKYYPNEQELVGKKVQIVANLKPRKMMKKYVSQGMILSAEHDGKLTLLTVDPAVPNGSVIG

SEQ ID NO: 4917 - protein, 304 aa, Streptococcus pneumoniae
  misc_feature (B) LOCATION 1...304
  hypothetical: YES
PNLVKEGRRRMVKERNLTRWIFVLPAMIIVGLLFVYPFFSSIFYSFTNKHLIMPNYKFVGLANYKAVLSDPNFFNAFFNSIKWTVFSLVGQVLVGFVLALALHRVRHFKKLYRTLLIVPWAFPTIVIAFSWQWILNGVYGYLPNLIVKLGLMEHTPAFLTDSTWAFLCLVFINIWFGAPMIMVNVLSALQTVPEEQFEAAKIDGASSWQVFKFIVFPHIKVVVGLLVVLRTVWIFNNFDIIYLITGGGPANATTTLPIFAYNLGWGTKLLGRASAVTVLLFIFLVAICFIYFAIISKWEKEGRK

SEQ ID NO: 4918 - protein, 348 aa, Streptococcus pneumoniae
  misc_feature (B) LOCATION 1...348
  hypothetical: YES
KSLVNSAKLLTTLMKRTWRNSFVTNLNTPFMIGNVEIPNRTVLAPMAGVTNSAFRTIAKELGAGLVVMEMVSDKGIQYNNEKTLHMLHIDEGENPVSIQLLGSDEDSLARAAEFIQENTKTDIVDINMGCPVNKIVKNEAGAMWLKDPDKIYSIINKVQSVLDIPLTVKMRTGWADPSLAVENALAAEAAGVSALAMHGRTREQMYTGHADLETLYKVAQALTKIPFIANGDIRTVQEAKQRIEEVGADAVMIGRAAMGNPYLFNQINHYFETGEILPDLTFEDKMKIAYEHLKRLINLKGENVAVREFRGLAPHYLRGTSGAAKLRGAISQASTLAEIEALLQLEKV

SEQ ID NO: 4919 - protein, 670 aa, Streptococcus pneumoniae
  misc_feature (B) LOCATION 1...670
  hypothetical: YES
YPLVYQYREFKTSIRHIRKRNKMTEEIKNLQAQDYDASQIQVLEGLEAVRMRPGMYIGSTSKEGLHHLVWEIVDNSIDEALAGFASHIQVFIEPDDSITVVDDGRGIPVDIQEKTGRPAVETVFTVLHAGGKFGGGGYKVSGGLHGVGSSVVNALSTQLDVHVHKNGKIHYQEYRRGHVVADLEIVGDTDKTGTTVHFTPDPKIFTETTIFDFDKLNKRIQELAFLNRGLQISITDKRQGLEQTKHYHYEGGIASYVEYINENKDVIFDTPIYTDGEMDDITVEVAMQYTTGYHENVMSFANNIHTHEGGTHEQGFRTALTRVINDYARKNKLLKDNEDNLTGEDVREGLTAVISVKHPNPQFEGQTKTKLGNSEVVKITNRLFSEAFSDFLMENPQIAKRIVEKGILAAKARVAAKRAREVTRKKSGLEISNLPGKLADCSSNNPAETELFIVEGDSAGGSAKSGRNREFQAILPIRGKILNVEKASMDKILANEEIRSLFTAMGTGFGAEFDVSKARYQKLVLMTDADVDGAHIRTLLLTLIYRYMKPILEAGYVYIAQPPIYGVKVGSEIKEYIQPGADQEIKLQEALARYSEGRTKPTIQRYKGLGEMDDHQLWETTMDPEHRLMARVSVDDAAEADKIFDMLMGDRVEPRREFIEENAVYSTLDV

SEQ ID NO: 4920 - protein, 147 aa, Streptococcus pneumoniae
  misc_feature (B) LOCATION 1...147
  hypothetical: YES
ETIVYTIIKSNIKKFSLLTIFIVAGQLLLIYAATINALVLNELIAMNLERFLKLSIYQMIVWCGIIFLDWVVKNYQVEVIRKFNLKIRNRVATDISNSTYQEFHSKSSGTYLSWLNNDVHTLNDQAFKQLFLVIKGDFWYYICSCDS

SEQ ID NO: 4921 - protein, 81 aa, Streptococcus pneumoniae
  misc_feature (B) LOCATION 1...81
  hypothetical: YES
GDIVGSQNQYFWIIGGATDLYNSKEEIGYSVSEVVHILSESLSVNCKESKTLKQIFETALLEVKDEIGLNSYKLTEYSKMK

SEQ ID NO: 4922 - protein, 301 aa, Streptococcus pneumoniae
  misc_feature (B) LOCATION 1...301
  hypothetical: YES
QSIVKKKRSFIMKKKNGKAKKWQLYAAIGAASVVVLGAGGILLFRQPSQTALKDEPTHLVVANEGSVASSVLLSGTVTAKNEQYVYFDASKGDLDEILVSVGDKVSEGQALVKYSSSEAQAAYDSASRAVAKADRHINELNQARNEAASAQAPQLPAPVGGEDATVQSPTPVAGNSVASIDAQLGDARDARADAAAQLSKAQSQLDATTVLSTLEGTVVEVNSNVSKSPTGASQVMVHIVSNENLQVKGELSEYNLXNLSVGQEVSFTSKVYPDKKWTGKLSYISDCPKNNGEAASPAAAE

SEQ ID NO: 4923 - protein, 305 aa, Streptococcus pneumoniae
  misc_feature (B) LOCATION 1...305
  hypothetical: YES
EVIVMIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGAFVQSVVDFVEAYKWVADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 4924 - protein, 132 aa, Streptococcus pneumoniae
  misc_feature (B) LOCATION 1...132
  hypothetical: YES
DVIVCKGDVMLNSIVTIICIALIAFILFWFFKKPEKSGQIAQQKNGYQEIRVEVMGGYTPELIVLKKSVPARIVFDRKDPSPCLDQIVFPDFGVHANLPMGEEYVVEITPEQAGEFGFACGMNMMHGKMIVE

SEQ ID NO: 4925 - protein, 450 aa, Streptococcus pneumoniae
  misc_feature (B) LOCATION 1...450
  hypothetical: YES
EVIVIGNVVSIDSQPKMITTAKGDIKANSPSNVLMSFKADDQLSIYLKHNDFSQEHELLKDIKIGNTLFKKGELPSNFDSVVKVYFESVLGVAFSSQAMLDGMETFFSERSYNPVIEYMEKAAEKWDGRKRIDRMLQVYLGAEDIPLVSKIAQMWLVGAVAKVYDPYVKFDYVLDLVGGQGVGKTSLLQKLGGEWYTDAVTDFSNKDNYDIMLKSLIVNDDEMVASNRMSFAETKAFISKTSLRYRKPYMKRTEEFAKNFILARTTNQTEYLKDKTGERRFLPVMADSKRQKKHPMEIEPETIEQIWGEAVTIYRAGADLMFDENTEDELNIYREQFMYRDEVELQVLEYLDMPVPENWQNWSIQQQHQYTSKYFDNSSDFDPGSKKLDKVSTREMMYNLFMRNSNDRKLSTKINMIMDNHPDWKKSVFRAGGKSTKGFVRVKDSEKTNR

SEQ ID NO: 4926 - protein, 132 aa, Streptococcus pneumoniae
  misc_feature (B) LOCATION 1...132
  hypothetical: YES
IKIVMIEIKFNPVILNNNAETTPNKEMTVMTGSNTLNDLLTAGGIFSPRFICKALTFDNSMNNSVAIIATITPANIAPVPVLLNERTPEMFTASFAPSGTTETVFGIITIKETNDSIDAANGFSKSLFLAKK

SEQ ID NO: 4927 - protein, 66 aa, Streptococcus pneumoniae
  misc_feature (B) LOCATION 1...66
  hypothetical: YES
TTVVNNHILILEVESQFFVVGEDTEKGATRTENQFDTFFNGLVNSSDVSLWDFLGFIEEGSIHIQG

SEQ ID NO: 4928 - protein, 412 aa, Streptococcus pneumoniae
  misc_feature (B) LOCATION 1...412
  hypothetical: YES
EGVVMKVFLQNRDFRQLTINQWISTLGDTIFYLAFLNYVADASFAPLAILLITISETLPQILQIFLGVLADFQHHRVLKYTVISFAKFLLYSIVSLSLSGQSFSLLLVAFICLLNLLSDTLSYFSGAMLTPIFIRIIGQDHLAEAIGFKQSTVSLVKTISNILGGVLLGILSIQFISLLNALTFLIAFLGILFIKTDLLKVEKTISYQEGLSVKSFCQHLLQSSKLIWNMNKVLLVLFIISTSQAVINVTVPISTLFLRNQPFLNLQTGQSLALLSTFELSALIVGSLVSGYLQHTISIKTALYASLVIQLLLLVGFATVRFDWILIFSTLDAFFAGVLSPRLQELVFKQIPEESMGAVQSSIGAITVVLPSLFTIALVTIATSFGTLAVSFVLLLFLLVAFVMLLNIRESI

SEQ ID NO: 4929 - protein, 106 aa, Streptococcus pneumoniae
  misc_feature (B) LOCATION 1...106
  hypothetical: YES
PSSVRNAAIPSLIISSSSATKMFISLPFYYQNSIHLFPICYLKISYQPIIYDNGMDFIYPLLFVNNNVNTRKSFILQLILFENLFKPRQLYLQSKNSVLSNLRLAA

SEQ ID NO: 4930 - protein, 157 aa, Streptococcus pneumoniae
  misc_feature (B) LOCATION 1...157
  hypothetical: YES
LHSVVKSLPAQTIQIGTLGVDFSRLIPGILIISMNSGAYVSETVRAGINAVPKGQLEAAYSLGIRPKNAMRYVILPQAVKNILPALGNEFITIIKDSSLLSAIGVMELWNGATTVSTTTYLPLTPLLFAAFYYLIMTSILTVALKAFEKHMGQGDKK

SEQ ID NO: 4931 - protein, 68 aa, Streptococcus pneumoniae
  misc_feature (B) LOCATION 1...68
  hypothetical: YES
IRSVTSMTRFISCSINMIVILNSSLIRRINSVNSAVSCGFIPAAGSSKKRILGSVARARTISKRRCCP

SEQ ID NO: 4932 - protein, 82 aa, Streptococcus pneumoniae
  misc_feature (B) LOCATION 1...82
  hypothetical: YES
TVSVGRMTAPPFSNSCLILSIINHDHPILTKLVFECSNFFFRKMFSKKFGNTLTLLVSNFKVNLTTILEIVFCIFRNSTVNS

SEQ ID NO: 4933 - protein, 72 aa, Streptococcus pneumoniae
  misc_feature (B) LOCATION 1...72
  hypothetical: YES
NISVKIRIMKKKRVSRMKKNRGIQKLAILVLLGVFMFSNTIPYQQFIQKNRQLEIRVQSQKKSNGLDVGKAD

SEQ ID NO: 4934 - protein, 323 aa, Streptococcus pneumoniae
  misc_feature (B) LOCATION 1...323
  hypothetical: YES
GYDLCATILRYVAPDKAGNFANVILGFDDFDSYVGNSPKHGASVGPVAGRIAGATFELNGKTYDLEVNNASNCNHSGSTGWDSSLFEVEEVSDHGLTLYTERTDGTGGFPGNLKIWISYHLEETGAYEISYKVTTDQDTLVNPTNHSYFNLSGDFTQTIDRHVFQLNTEGIYSIAPDGVPAKTPEANRDVVKHVYNGTLLKDIFAEEDEQIQLASGLDHPFALPAGHDNAGFLYDQNSGRFLLFKTEAPCFVVYTANFVDESVIIGGQPMLQHNGIALEAQALPDAIHSDLKGQVILKAGQTFTSKTRYELVVKSSRHRGILN

SEQ ID NO: 4935 - protein, 74 aa, Streptococcus pneumoniae
  misc_feature (B) LOCATION 1...74
  hypothetical: YES
IFPVQMFQVNLRLPMILRQQTGFWQKCLLTSPNLLELNCHLILILFTLIKRQLFSTNIRSSLSTALTLSETASI

SEQ ID NO: 4936 - protein, 80 aa, Streptococcus pneumoniae
  misc_feature (B) LOCATION 1...80
  hypothetical: YES
KQPVVKRDKMAKSNFEKVESVVGWVRDKKITGYRISKETNAREMSIIALAQGRAKVKNISFETALGLIDFYEKNYEKFED

SEQ ID NO: 4937 - protein, 119 aa, Streptococcus pneumoniae
  misc_feature (B) LOCATION 1...119
  hypothetical: YES
HKPVFLINSCLGLFSATYSRRHPFSRSYGVNLPSSLTAILPMVLGFSPHLPVSVCGTGTELLDRDFSWQHEIRYFGSKLPHHYTPDLTKDGFSYLSSSVLRRTSNNVRISYPPASSHFS

SEQ ID NO: 4938 - protein, 260 aa, Streptococcus pneumoniae
  misc_feature (B) LOCATION 1...260
  hypothetical: YES
LFTVELRKMQKTISRMVVRFTLKLDTSKVKVFPNFLENIFLKKKFEHSKTNLVKIGWSWLMMDRIRQELEKGGAVILPTETVYGLFAKALDEKAVDHVYQLKRRPRDKALNLNVASLEDILHFSKNQPAYLQKLVETFLPGPLTIILEANDRVPYWVNSDLATIGFRMPSHPITLDLIRETGPLIGPSANISGQASGVTFEQILKDFDQEVLGLEDDAFLTGQDSTIVDLSGDKVKILRQGAIKREDILARLPEISFEEA

SEQ ID NO: 4939 - protein, 98 aa, Streptococcus pneumoniae
  misc_feature (B) LOCATION 1...98
  hypothetical: YES
ALDLTNVQLYYHIIIPQVLRRLLPQAINLVTRMIKTTSLVVLIGVVEVTKVGQQIIDSNRLTIPTASFWIYGTILVLYFAVCYPISKLSTHLEKHWRN

SEQ ID NO: 4940 - protein, 103 aa, Streptococcus pneumoniae
  misc_feature (B) LOCATION 1...103
  hypothetical: YES
VCTVKERIMPVRKLQSYEVDYQEELNQQLPHYQAYTPEAQSDANLKEILFFINIAVFCICIAIFSFIFLALKLSTALAFAAAIGFSLLVLKVQRSIIKRKRRR

SEQ ID NO: 4941 - protein, 105 aa, Streptococcus pneumoniae
  misc_feature (B) LOCATION 1...105
  hypothetical: YES
ERTVGFIAAMCIDNCLASASSPPSTTEITPIRPPLCWYAPKCCASVFSINAKRRNEIFSPIVAVADTYAASRVSPEGIIKARASSLLAGFPSAMTLAVVFTNSTN

SEQ ID NO: 4942 - protein, 285 aa, Streptococcus pneumoniae
  misc_feature (B) LOCATION 1...285
  hypothetical: YES
RPTVFAGVILHVMLGSTYAWSVYRNPIIEKTGWDQASVAFAFSLAIFCLGLSAAFMGRLVEKFGPKVMGSLSAFLYAGGNILTGFAIDRQELWLLYLAYGILGGLGLGAGYITPVSTIIKWFPDKRGLATGLAIMGFGFASLLTSPIAQHLIAGVWIVETFYILGASYFIIMLLASQFIKRPNEQELAILSSSGKEKTASLTQGMAANQALKSNRFYMLWIIFFINIXCGLGLISAASPMAQEMAGLSTSHAAVMVGVLGIFNGFGRLLWASLSDYIGPPLTFNI

SEQ ID NO: 4943 - protein, 85 aa, Streptococcus pneumoniae
  misc_feature (B) LOCATION 1...85
  hypothetical: YES
FLAVNLPLYTFLISPVSRNPVLSHLVHFLGSNLEFNRPFWSINSRMDRLITIGLAVGNIVFEATWHRFPKFMHVTKHGINITLGI

SEQ ID NO: 4944 - protein, 642 aa, Streptococcus pneumoniae
  misc_feature (B) LOCATION 1...642
  hypothetical: YES
KAAVLAKIQEQGKLTKELEEAILVAEKLADVEELYLPYKEKRRTKATIAREAGLFPLARLILQNIVDLEKEAEKFVCEGFATGKEALTGAVDILVEALSEDVTLRSMTYQEVLRHSKLTSQAKDESLDEKQVFQIYYDFSETVGTMQGYRTLALNRGEKLGVLKIGFEHATDRILAFFATRFKVKNAYIDEVVQQSVKKKVLPAIERRIRTELTEKAEEGAIQLFSDNLRNLLLVAPLKGRVVLGFDPAFRTGAKLAVVDATGKMLTTQVIYPVKPASARQIEEAKKDLADLIGQYGVEIIAIGNGTASRESEAFVAEVLKDFPEVSYVIVNESGASVYSASELARQEFPDLTVEKRSAISIARRLQDPLAELVKIDPKSIGVGQYQHDVSQKKLSESLDFVVDTVVNQVGVNVNTASPALLSHVAGLNKTISENIVKYREEEGKITSRSQIKKVPRLGAKAFEQAAGFLRIPESSNILDNTGVHPENYTAVKELFKRLDIKDLNEEAQSKLKSLSVKEMAQELDLGPETLKDIIADLLKPGRDFRDSFDAPVLRQDVLDIKDLVVGQKLEGVVRNVVDFGAFVDIGIHEDGLIHISHMSRKFIKHPSQVVSVGDLVSVWVKQIDTEREKVNLSLLAPNETD

SEQ ID NO: 4945 - protein, 68 aa, Streptococcus pneumoniae
  misc_feature (B) LOCATION 1...68
  hypothetical: YES
PQAVLEYGKTTLTWFEEIFEEYKSLRTNHYPVVTKKKLRQTELNFFFSVVSAMLVLHLTFYLIRQIQD

SEQ ID NO: 4946 - protein, 64 aa, Streptococcus pneumoniae
  misc_feature (B) LOCATION 1...64
  hypothetical: YES
QRAVFLINSCLGLFTAADFKSAPLLPKLRGHFAEFLNESSLAHLRLLASTTCVCLRYGYSMFKR

SEQ ID NO: 4947 - protein, 65 aa, Streptococcus pneumoniae
  misc_feature (B) LOCATION 1...65
  hypothetical: YES
QRAVFLINSCLGLFTAADFKSAPLLPKLRGHFADVPYIESSLAHLSYSPRLPVSVCGTGRVCLIR

SEQ ID NO: 4948 - protein, 73 aa, Streptococcus pneumoniae
  misc_feature (B) LOCATION 1...73
  hypothetical: YES
NFYVKSLGINFYLFFPTHLSTILLRKHGLISKRTSKRYYHVAIPFTRLFCPALVSIDYIRGETFFGSLSTVVG

SEQ ID NO: 4949 - protein, 329 aa, Streptococcus pneumoniae
  misc_feature (B) LOCATION 1...329
  hypothetical: YES
IEDLKNQTYPKENIEILFINAMSTDGTTAIIQQFIKEDTEFNSIRLYNNPKKNQASGFNLGVKHSVGDLILKIDAHSKVTESFVMNNVAIIQQGEFVCGGPRPTIVEGKGKWAETLHLVEENMFGSSIANYRNSSEDRYVSSIFHGMYKREVFQKVGLVNEQLGRTEDNDIHYRIREHGYKIRYSPSILSYQYIRPTFKKMLHQKYSNGLWIGLTSHVQFKCLSLFHYVPCLFVLSLVFSLALLPITFVFITLLLGAYFLLLSLLTLLTLLKHKNGFLIVMPFLLFSIHFAYGLGTIVGLIRGFKWKKEYKRTIIYLDKISQINQNMLQ

SEQ ID NO: 4950 - protein, 225 aa, Streptococcus pneumoniae
  misc_feature (B) LOCATION 1...225
  hypothetical: YES
EYYVMLSKEDYTEEIGLIKKQNYVEAELYPIVADIIKPTLKDSLSKRYVFGRQRRGLGQIYYGLSNFPDIVILDKTYENKSRKSIKIEEWKKLRGCVEVKNLNYSLITEEKIKSTISNSFEHITGEMEQLTGEMGQLIGDLLWYKKVIYTNGIEWRFLSLDDKEEIDNTIVEVVNKRIETEEAGNSFDWWKNIKDLSFNYTDICLSKDCRQEWNEFVKRVKEIEW

SEQ ID NO: 4951 - protein, 376 aa, Streptococcus pneumoniae
  misc_feature (B) LOCATION 1...376
  hypothetical: YES
GRDFRAFFHSRVRNDLKYGIIKGNFYRKEKIMSNFAIILAAGKGTRMKSDLPKVLHKVAGISMLEHVFRSVGAIQPEKTVTVVGHKAELVEEVLAGQTEFVTQSEQLGTGHAVMMTEPILEGVSGHTLVIAGDTPLITGESLKNLIDFHINHKNVATILTAETDNPFGYGRIVRNDNAEVLRSLLSRRMLQILKSKSRKSTLVTYVFDNERLFEALKNINTNNAQGEYYITDVIGIFRETGEKVGAYTLKDFDESLGVNDRVALATAESVMRRRINHKHMVNGVSFVNPEATYIDIDVEIAPEVQIEANVILKGQTKIGAETVLTNGTYVVDSTIGAGAVITNSMIEESSVADGVTVGPYAHIRPNSSLGAPSSYW

SEQ ID NO: 4952 - protein, 78 aa, Streptococcus pneumoniae
  misc_feature (B) LOCATION 1...78
  hypothetical: YES
YSYVCVVLIVTAFLMIESILESSSGGYNLFRGNSSPAIPCWNDKLLTKFPNSVEEVILPSEFTVLSSKNCRTLLHSVL

SEQ ID NO: 4953 - protein, 495 aa, Streptococcus pneumoniae
  misc_feature (B) LOCATION 1...495
  hypothetical: YES
KEYVLKELDQNQAPIYEALVKLRKKRIVPFDVPGHKRGRGNPELVELLGEKCVGIDVNSMKPLDNLGHPISIIRDAEELAADAFGASHAFLMIGGTTSSVQTMILATCKAGDKIILPRNVHKSAINALVLCGAIPIYIEMSVDPKIGIALGLENDRVAQAIKDHPDAKAILINNPTYYGICSDLKGLTEMAHEAGMMVLVDEAHGAHLHFTGKLPISAMDAGADMAAVSMHKSGGSLTQSSLLLIGEQMNPEYVRQIINLTQSTSASYLLMASLDISRRNLALRGKESFEEVIELSEYARHEINAIGGYYAYSKELIDGVSVCDFDVTKLSVYTQGIGLTGIEVYDLLRDEYDIQIEFGDIGNILAYISIGDRIQDIERLVGALADIKRLYSRDGKDLIAGEYIQPELVLSPQEAFYSERKSLTLDESVGQVCGEFVMCYPPGIPILAPGERITREIVDYIQFAKERGCSLQGTEDPEVNHINVIKRKTNYKKSQ

SEQ ID NO: 4954 - protein, 102 aa, Streptococcus pneumoniae
  misc_feature (B) LOCATION 1...102
  hypothetical: YES
KTDFARIKMTLSNYFYKVKQQYPLTEKQQELYDILGDVNPEYALKYMTAFLLKFLKKDQLMQKCRDIFVDSLVVLGYIVQNEDRKYELAIDFDKERLTFYLA

SEQ ID NO: 4955 - protein, 88 aa, Streptococcus pneumoniae
  misc_feature (B) LOCATION 1...88
  hypothetical: YES
LYNVITPSVIVLADQNKADWSYDENTVINIYDDANFEDGRLHMTFEQFFKLAQIAREEGLEIHSPFERAGATKSARYIAKWILRNKKH

SEQ ID NO: 4956 - protein, 341 aa, Streptococcus pneumoniae
  misc_feature (B) LOCATION 1...341
  hypothetical: YES
KNNVTFISADIFRYQIYMKGRGMKLSHYLIGLLLLLVFLSISIGTSDFSWGKLFDFDQQTWLLFQESRLPRTISILLTASSMSMAGLLMQTITQNQFAAPSTVGTTEAAKLGMVLSLFVFPSASLTQKMLFAFVSSIVFTLFFLAFMTIFTVKERWMLPLIGIIYSGIIGSVTEVIAYRFNLVQSMTAWTQGSFSMIQTHQYEWLFLGLIILITVWKLSQTFTIMNLGKETSESLGISYSLLEKLALFLVALTTSVTMITVGGLPFLGVIVPNLVRKCYGDNLSQTKLMVALVGANLVLACDILSRVLIRPYELSVSLLLGIIGSLVFILLLWRGGRKDAD

SEQ ID NO: 4957 - protein, 279 aa, Streptococcus pneumoniae
  misc_feature (B) LOCATION 1...279
  hypothetical: YES
VINVSKHYGHSIILKDINFALNKGEIVGLVGRNGVGKSTLMKILVQNNQPTSGNIISSDNIGYLIEEPKLFLSKTGLENLKYLSNLYGVDYNQERFRSLIQELDLTQSINKKVKTYSLGTKQKLALLLTLVTKPDILILDEPTNGLDIESSQIVLAVLKKLALNENVGILISSHKLEDIEEICERVLFLESGLLTFQKVGKDSHNFLFEIAFSSATDRDIFITKQEFGDIVQEEGLRITMSGNIQSSELFKFFNENSIKVVDFETKKETLKDIYLNRSK

SEQ ID NO: 4958 - protein, 141 aa, Streptococcus pneumoniae
  misc_feature (B) LOCATION 1...141
  hypothetical: YES
LTNVDFGGMVMQISDAEWQVMKIIWMQGEQTSTDLIRVLAERFDWSKSTIQTLLARLVEKECLTRKKEGKFFVYSALLTLDQSRDLLVQDIKDKVCSRRIRNLLADLIVECEFTQTDLEDLEAVISEKKSSAVTEVRCNCM

SEQ ID NO: 4959 - protein, 87 aa, Streptococcus pneumoniae
  misc_feature (B) LOCATION 1...87
  hypothetical: YES
KENVMSERRISEKSLENLRKSNQESNLLTREAIETALLQLLEKKELTKISISELVKRAGVSRAAFYRNYDSKGGILERSLKELSTIL

SEQ ID NO: 4960 - protein, 88 aa, Streptococcus pneumoniae
  misc_feature (B) LOCATION 1...88
  hypothetical: YES
MKNVELKEKNMTFEEILPGLKAKRKYVRTGWGGAENYVQLFDTIEQNGLALEMTPYFLINVSGEGEGFSMWSPTVCDVLATDWVEVHD

SEQ ID NO: 4961 - protein, 93 aa, Streptococcus pneumoniae
  misc_feature (B) LOCATION 1...93
  hypothetical: YES
NRDVTSTDSHSFIIIDSTKEIQDIVVIIKGLTDSHDNDMADAFILTTLSKVFLNQHDLRYDFTVIEVTLLLNQTRGTEGTTDITADLSGHTDR

SEQ ID NO: 4962 - protein, 118 aa, Streptococcus pneumoniae
  misc_feature (B) LOCATION 1...118
  hypothetical: YES
TRDVDLMNTIERTRRLVKGCATHCFEVADRTDEVSSKHCFEVVDRTDEVSSKHCFEVADETDEVSSKHVFEVVDETDEVSSKHVFEVVDETDEVSSKHVFEVVDETDEVSNHTYGKAT

SEQ ID NO: 4963 - protein, 171 aa, Streptococcus pneumoniae
  misc_feature (B) LOCATION 1...171
  hypothetical: YES
NSCVKSLGINFYLFLPTHLSTILLRKHGLISKSTSKGYYQVAIPFMRLFCLVLVSIDYINCLSETTDKNWHKSDRVFVTNTGKTVHSSILSKSLQRANERLKKPIPKHLSPHIFRHTTISILSENKIPLKTITDRVGHSDSEVTTSIYTHVTKNMKDEAINVLDKVMKKIF

SEQ ID NO: 4964 - protein, 100 aa, Streptococcus pneumoniae
  misc_feature (B) LOCATION 1...100
  hypothetical: YES
GXRVLFYNPAKSTVNEEDYLTVIPHLPKKGFSRDFLAYFALFLKDTAEVGLDVLMDFLEDPEAEEFVMEWNQEVLEEGKVGLEEGEFTLIRDTRSWLEVL

SEQ ID NO: 4965 - protein, 298 aa, Streptococcus pneumoniae
  misc_feature (B) LOCATION 1...298
  hypothetical: YES
MESVGDVLKRQPSRFHYQDLVQKIMKDPDVAAFVQQESLNQDELNRSISKFNQYITERDKFLRGDTDYIAKGYKPILVMNHGYADVSYEETPELIAAEKEAAIKKRLNLINFPSSLKNVSFLDVYRDDVQRLTVLKRMIEFVNDYPNNLKGLYLYGDFGVGKSFMVAALAHDLSEKRGVSSTLLHYPSFVIDVKNAISDGNVKTLVDEIKLSEVLILDDIGAEQSTTWVRDEILQVILQYRMQENLPTFFTSNFNFEDLEKHFAKGKNGNDETWEARRVMERIRYLAEETRLEGVNRR

SEQ ID NO: 4966 - protein, 202 aa, Streptococcus pneumoniae
  misc_feature (B) LOCATION 1...202
  hypothetical: YES
ERGVFLAVDNEIKGLLALQDIPKENAKLAISQLKKRGLRTVMLTGDNAGVACAIADQIGIEEVIAGVLPEEKAHEIHKLQQSGKVAFVGDGINDAPALSVADVGIAMGAGTDIAIESADLVLTTNNLLGVVRAFDMSKKTFHRILLNLFWAFIYNVVGIPIAAGVFSGVGLALNPELAGLAMAFSSVSVLTSSLLLNFSKID

SEQ ID NO: 4967 - protein, 151 aa, Streptococcus pneumoniae
  misc_feature (B) LOCATION 1...151
  hypothetical: YES
IGGVMKDSHLLAHHIRLLNGRIFQKLLSQDPEALYRGEQGKILAVLWNSETGCATATDIALATGLANNTLTTMIKKLEEQKLVIVSPCGKDKRKKYLVLTELGKSQKEVGHRVSQKLDTIFYKGFSEEEIHQFEGFQERILANLKEKGNEV

SEQ ID NO: 4968 - protein, 66 aa, Streptococcus pneumoniae
  misc_feature (B) LOCATION 1...66
  hypothetical: YES
LDFVNQVLCLFPHIAITSEDSFGQWTMLGDLVGLIFCLMLVLENKFSVASKATLFSKAGQSSLRNM

SEQ ID NO: 4969 - protein, 75 aa, Streptococcus pneumoniae
  misc_feature (B) LOCATION 1...75
  hypothetical: YES
ADFVSFIDNLKHCFEQPAANFLVCSLIFIEYDFSGCQFSLDKRRVGKRVVLPRPHTYFLAYRNCNRGRLTCHRAE

SEQ ID NO: 4970 - protein, 261 aa, Streptococcus pneumoniae
  misc_feature (B) LOCATION 1...261
  hypothetical: YES
RRFVMKNNRILALSGNDIFSGGGLSADLATYTLNGLHGFVAVTCLTALTEKGFEVFPTDDTIFQHELDSLRDVEFGGIKIGLLPTVSVAEKALDFIKQRPGVPVVLDPVLVCKETHDVAVSELCQELIRFFPYVSVITPNLPEAELLSGQEIKTLEDMKTAAQKLHDLGAPAVIIKGGNRLSQDKAVDVFYDGQTFTILENPVIQGQNAGAGCTFASSIASHLVKGDKFLPAVESSKAFVYRAIAQADQYGVRQYEANKNN

SEQ ID NO: 4971 - protein, 137 aa, Streptococcus pneumoniae
  misc_feature (B) LOCATION 1...137
  hypothetical: YES
FKFVLFVKQMKQFQLRRRKQMELVLPNNYVVIDEEEMMYLDGGAYLSKRACQGICVALAMSSGTFIALAGAAVLTKKLINYIKVGSFGGWLIGAAAGVLAGAAGRIAYCIGYGTLNRDCDISGNPYPWDGFISATVR

SEQ ID NO: 4972 - protein, 184 aa, Streptococcus pneumoniae
  misc_feature (B) LOCATION 1...184
  hypothetical: YES
IFLVRNRCYQWYRLVRVIMRCWGCSSMRRMLTAKLQNRSGVLNRFTGVLSRRQVNIESISVGATEDPNVSRITIIIDVASHDEVEQIIKQLNRQIDVIRIRDITDKPHLEREVILVKMSAPAEKRAEILAIIQPFRATVVDVAPSSITIQMTGNAEKSEALLRVIRPYGIRNIARTGATGFTRD

SEQ ID NO: 4973 - protein, 74 aa, Streptococcus pneumoniae
  misc_feature (B) LOCATION 1...74
  hypothetical: YES
NPLVAPVTPAQRATPNLAPMYPHAPINGAPTPLAAQIAVPNPQPPKAAPPPSKTLVCQLFLPPSILDNIVISIS

SEQ ID NO: 4974 - protein, 232 aa, Streptococcus pneumoniae
  misc_feature (B) LOCATION 1...232
  hypothetical: YES
QPLVWLRSKGILQGIICLRMEPLPSKTSPVSWLLRRLIYKVMSECLILCGSRWKTAHIASYLTTGQVTALDLYDHKLDLIQENAQRLGVADRVQTQKLDARKVHEFFDQDSFDKILVDAPCSGIGLLRRKPDIKYNKETADFASLQEIQLEILGSVCQILGKGGIITYSTCTIVSEENFQVVKAFLESHPEFEQVKLEHECKDIMKDGCILITPELYGSDGFFISQFRKISD

SEQ ID NO: 4975 - protein, 144 aa, Streptococcus pneumoniae
  misc_feature (B) LOCATION 1...144
  hypothetical: YES
GALVVTRHGHFATGIYSSLQLIAGNQENVEAIDFVEGMSADELKQKILLAISNEEEVLILSDLLGGSPFKVSSTIMGENPAKTMNVLSGLNLAMLMEAVFARMAHSFDEVVNKSVVAAQGGVVNGKELFSTDAEEEEEDFESGI

SEQ ID NO: 4976 - protein, 670 aa, Streptococcus pneumoniae
  misc_feature (B) LOCATION 1...670
  hypothetical: YES
AQLVVKTRWLKRSSNAITNDLDNSPTVNQNRSAEMIASNSTTNGLDNSLSVNSISSNGTIRSNSQLDNRTVESTVTSTNENKSYKEDVISDRIIKKEFEDTALSVKDYGAVGDGIHDDRQAIQDAIDAAAQGLGGGNVYFPEGTYLVKEIVFLKSHTHLELNEKATILNGINIKNHPSIVFMTGLFTDDGAQVEWGPTEDISYSGGTIDMNGALNEEGTKAKNLPLINSSGAFAIGNSNNVTIKNVTFKDSYQGHAIQIAGSKNVLVDNSRFLGQALPKTMKDGQIISKESIQIEPLTRKGFPYALNDDGKKSENVTIQNSYFGKSDKSGELVTAIGTHYQTLSTQNPSNIKILNNHFDNMMYAGVRFTGFTDVLIKGNRFDKKVKGESVHYRESGAALVNAYSYKNTKDLLDLNKQVVIAENIFNIADPKTKAIRVAKDSAEYLGKVSDITVTKNVINNNSKETEQPNIELLRVSDNLVVSENSIFGGKEGIVIEDSKGKITVLNNQFYNLSGKYISFIKSNANGKEPVIRDSDGNFNIVTENGLYKIVTNNLSDKNEKEKNKEEKQYNSNNVIDSNQKNGEFNSSKDNRQMNDKIDNKQDNKTEEVNYKIVGDGRETENHINKSKEIVDVKQKLPKRGSYKIMELFLTVTGIGLLLTLKGLKYYGKDK

SEQ ID NO: 4977 - protein, 124 aa, Streptococcus pneumoniae
  misc_feature (B) LOCATION 1...124
  hypothetical: YES
MELVLPNNYVVLEQEEMMYLDGGFSIPRWPVATAINIAFNGVLGGGAISLVRNYIRNYGLRRVTSAIAGAAARYVGVRVANRVAGFALSAINGFAAWMSIGDAITTIWANNDVNRRDPNLNALW

SEQ ID NO: 4978 - protein, 164 aa, Streptococcus pneumoniae
  misc_feature (B) LOCATION 1...164
  hypothetical: YES
RELVLPNNYVALEQEEMMYLDGGGYLSKSACQGICAALAMSPGTFIALTGAAVLTKKLINYIKVGGLGGWLIGAAAGVLALIFLIKICVDTTIKVLLNRIFKASKVMKRRIFSLFVLDLMVYIFLGYVLVIQKDVYLFSILIIFSNFSVPFIREKEYELFKNKK

SEQ ID NO: 4979 - protein, 197 aa, Streptococcus pneumoniae
  misc_feature (B) LOCATION 1...197
  hypothetical: YES
NALVVKLVKASMDGQLEEKGNLTDKIKSLSKGGQQKIQLIITLIHEPDLIILDEPFSGLDPVNTELLKQVIFQEKERGATIIFSDHVMTNVEELCDDILMIRDGRVVLHGPVQDVRNQYGKTRLFVSSERSKEELENLPHVKQVSLTKQGSWKLILEDESAGRELFPILTQGQYIATFDQQAPTIDEIFKLESGVEV

SEQ ID NO: 4980 - protein, 249 aa, Streptococcus pneumoniae
  misc_feature (B) LOCATION 1...249
  hypothetical: YES
STCFSFYCFKPVYFYKGVIMEFTDIAMELSKKAWQASFHHPFILQLQEGNLEPAIFRYYLIQDAYYLKAFSEIYHLLADKTSNQEMKRLLKQNAQGLVEGELFIRQQFFKEMEISDQEMEQHPIAPTCYHYISHIYRQFAEPNLAIAFASLLPCPWLYHDIGKSLNLKPSPNPLYQQWIETYITDELEQQIREEGALVNQLYRESDETDKQKMLDAFHISVHMEAKFWEMAYQHQTWKSDLQSLEKGEE

SEQ ID NO: 4981 - protein, 375 aa, Streptococcus pneumoniae
  misc_feature (B) LOCATION 1...375
  hypothetical: YES
ILCFYLFIRKRRLFFRRKLIAYLKFSPLCWIVPSIYVIMKEGFKIGKGVFMLKLGVIGTGAISHHFIEAAHTSGEYQLVAIYSRKLETAATFASRYQNIQLFDQLEVFFKSSFDLVYIASPNSLHFAQAKAALSAGKHVILEKPAVTQPQEWFDLIQTAEKNNCFIFEAARNYHEKAFTTIKNFLADKQVLGADFNYAKYSSKMPDLLTGQTPNVFSDRFAGGALMDLGIYPLYAAVRLFGKANDATYHAQQLDNSIDLNGDGILFYPDYQVHIKAGKNITSNLPCEIYTTDGTLTLNTIEHIRSAIFTDHQGNQVQLPIQQTHHTMTEEVAAFAHMIQQPDLNLYQTWLDDAGSVHELLYTMRQTAGIRFEAEK

SEQ ID NO: 4982 - protein, 369 aa, Streptococcus pneumoniae
  misc_feature (B) LOCATION 1...369
  hypothetical: YES
GECLMLERLKSIHYMFWISLIFMVFPILTVVTGWLSAWHLLIDILFVVAYLGVLTTKSQRLSWLYWGILLTYVVGNTAFVAVNYIWFFFFLSNLLSYHFSVGGLKSLHVWTFLLAQVLVVGQLLIFQRIEVEFLFYLLVILAFVDLMTFGLVRIRIVEDLKEAQAKQNAQINLLLAENERNRIGQDLHDSLGHTFAMLSVKTDLALQLFQMEAYPQVEKELKEIHQISKDSMNEVRTIVENLKSRTLTSELETVKKMLEIAGIEVETDNQLDTASLTQELESMASMILLELVTNIIKHAKASKAYLKLERTEKELILTVSDDGCGFAFLKGDELHTVRDRVFPFSGEVSVISQKHPTEVQVRLPYKERN

SEQ ID NO: 4983 - protein, 475 aa, Streptococcus pneumoniae
  misc_feature (B) LOCATION 1...475
  hypothetical: YES
ARSVVKTDCLFREIIDQGHYHYNYSKVIFDSISYDSRKVTEDTLFFAKGAAFKKEYLLSAITQGLAWYVAEKDYEVDIPVIIVNDIKKAMSLIAMEFYGNPQEKLKLLAFTGTKGKTTATYFAYNILSQGHRPAMLSTMNTTLDGETFFKSALTTPESIDLFDMMNQAVLNDRTHLIMEVSSQAYLVHRVYGLTFDVGVFLNITPDHIGPIEHPSFEDYFYHKRLLMENSRAVIINSDMDHFSVLKEQVEDQDHDFYGSQFDNQIENSKAFSFSATGKLAGDYDIQLIGNFNQENAVAAGLACLRLGASLEDIKKGIAATRVPGRMEVLTQKNGAKVFIDYAHNGDSLKKLINVVETHQTGKIALVLGSTGNKGESRRKDFGLLLNQHPEIQVFLTADDPNYEDPMAIADEISSYINHPVEKIADRQEAIKAAMAITNHELDAVIIAGKGADCYQIIQGKKESYPGDTAVAENYL

SEQ ID NO: 4984 - protein, 80 aa, Streptococcus pneumoniae
  misc_feature (B) LOCATION 1...80
  hypothetical: YES
AQPVQVLVVSLLKATSSVSMIWKKLLTALKECKLALPFKQDVKFVSWSIQEKSRTTKSQSWLTKFVRKLKTISIIQEISR

SEQ ID NO: 4985 - protein, 414 aa, Streptococcus pneumoniae
  misc_feature (B) LOCATION 1...414
  hypothetical: YES
NSTVSNNYIHNQVHTCEVGWNRGPATPTFCQVCFFHKGVLMLDIKRIRTDFEAVAEKLATRGVDAAVLNEMKEIDAKRRNILVKVETLKAERNTVSAEIAQAKRNKENTDDKIAAMQNLSAEVKALDAELAEIDAKLTEFTTTLPNIPADSVPVGADEDDNVEVRRWGTPREFDFEPKAHWDLGEDLGILDWERGGKVTGARFLFYKGLGARLERAIYNFMLDEHGKEGYTEVITPYIVNHDSMFGTGQYPKFKEDTFELSDTNFVLIPTAEVPLANYYRDEILDGKDLPIYFTAMSPSFRSEAGSAGRDTRGLIRLHQFHKVEMVKFAKPEESYEELEKMTANAENILQKLNLPYRVVALSTGDMGFSAAKTYDLEVWIPAQNNYVKSQAVQTQKISKPFVPKSVTVMKQMAR

SEQ ID NO: 4986 - protein, 407 aa, Streptococcus pneumoniae
  misc_feature (B) LOCATION 1...407
  hypothetical: YES
IRCFRTWYGSIKELSTGEHEAVELRDGDKSRYGGLGTQKAVDNVNNIIAEAIIGYDVRDQQAIDRAMIALDGTPNKGKWGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFIGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 4987 - protein, 911 aa, Streptococcus pneumoniae
  misc_feature (B) LOCATION 1...911
  hypothetical: YES
GARFSSTDSYQNHKFTFKTLKFKFRMRFYFMENVVVHIISHSHWDREWYLPFESHRMQLVELFDNLFDLFENDPEFKSFHLDGQTIVLDDYLQIRPENRDKVQRYIDEGKLKIGPFYILQDDYLISSEANVRNTLIGQQEAAKWGKSTQIGYFPDTFGNMGQAPQILQKSGIHVAAFGRGVKPIGFDNQVLEDERFTSQFSEMYWQGVDGSRVLGILFANWYSNGNEIPVDKDEALIFWKQKLSDVRAYASTNQWLMMNGCDHQPVQKNLSEAIRVANELFPDVIFVHSSFDEYVQAVEGALPEHLSTVTGELTSQETDGWYTLANTSSSRIYLKQAFQENSNLLEQVVEPLTIITGGHNHKDQLTYAWKTLLQNAPHDSICGCSVDEVHREMETRFAKVNQVGNFVKSNLLNEWKGKIATDKAQSDYLFTVINTGLHDKVDTVSTVIDVATCDFKELHPTEGYKKMAALILPSYRVEDLDGRPVEATIEDLGANFEYDLPKDKFRQARIARQVRVTIPVHLAPLSWTTFQLLEGKQEHREGIYQNGVIDTPFVTVSVDDNITVYDKTTHEAYEDFIRFEDRGDIGNEYIYFQPKGTEPIFAELKGHEVLENTACYAKILLKHELTVPVSADEKLEEEQQGIIEFMKREAGRSEELTNIPLETELTVFVDNPQIRFKTRFTNTAKDHRIRLLVKTHNTRPSNDSESIYEVVTRPNKPAASWENPENPQHQQAFVSLYDDEKGVTVSNKGLNEYEILGDNTIAVTILRASGELGDWGYFPTPEAQCLREFEVEFALECHQAQERFSAYRRAKALQTPFTSLQLARQEGSVVATGSLLSHSVLSIPQVCPTAFKVAENEEGYVLRYYNMSQENVRISEHQQTILDLLERPYPVHSGLLAPQEIRTEFIKKEEI

SEQ ID NO: 4988 - protein, 236 aa, Streptococcus pneumoniae
  misc_feature (B) LOCATION 1...236
  hypothetical: YES
FWYVEFWYLFLAQILANMIGLTTIYWLFNQIITYGVIAAVVIFSPEIRTGLERLGRATDFFSNAPISAEEQMIRAFVKSVEYMSPRKIGALVAIQRVRTLQEYISTGIPLDAKISAELLINIFIPNTPLHDGAVIIKEERIAVTSAYLPLTKNTGISKEFGTRHRAAIGLSEVSDALTFVVSEETGGISITYNGRFKHNLTLDEFETELREILLPKEEVGLSFKERWLGGWKHEKK

SEQ ID NO: 4989 - protein, 92 aa, Streptococcus pneumoniae
  misc_feature (B) LOCATION 1...92
  hypothetical: YES
NSHVGACAVLAGVIEPASAEPVRVGDNVLIGANAVVIEGVQIGSGSVVAAGAIVTQDVPENVVVAGVPARIIKEIDAQTQQKTALEDALRTL

SEQ ID NO: 4990 - protein, 159 aa, Streptococcus pneumoniae
  misc_feature (B) LOCATION 1...159
  hypothetical: YES
ILFLTKKLRNWRTNMKLEKHLIKLNKQFSNKEEAICYCGQVLYEGGYVNEDYIEAMIERDKELSVYMGNFIAIPHGTDAAKKDVLKSGITVVQVPRGVDFGNVSNPQVATVLFGIAGIGNEHLEIIQKISIFCADVDNVLKLADAQSKEEVLRLFDAVE

SEQ ID NO: 4991 - protein, 131 aa, Streptococcus pneumoniae
  misc_feature (B) LOCATION 1...131
  hypothetical: YES
GGHVIDVNLINGIALAFEGDAVYSMYIRRHLILKGMTKPNKLHQEATKYVSAKAQARLIALMLEEQVLTEKEEEIYKRGRNTNSHTKAKNADVVTYRMSTGFEAVMGYLHMTENLERLESLVSWCIQKVEG

SEQ ID NO: 4992 - protein, 678 aa, Streptococcus pneumoniae
  misc_feature (B) LOCATION 1...678
  hypothetical: YES
PLHVHRDATPQMMVISSMHLISSKIRGDAYIVPHGDHYHYIPKNELSASELAAAEAFLSGRENLSNLRTYRRQNSDNTPRTNWVPSVSNPGTTNTNTSNNSNTNSQASQSNDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQ

SEQ ID NO: 4993 - protein, 504 aa, Streptococcus pneumoniae
  misc_feature (B) LOCATION 1...504
  hypothetical: YES
ETNVKKISLLLASLCALFLVACSNQKQVDGKLNIVTTFYPVYEFTKQVAGDTANVELLIGAGTEPHEYEPSAKAVAKIQDADTFVYENENMETWVPKLLDTLDKKKVKTIKATGDMLLLPGGEEEEGDHDHGEEGHHHEFDPHVWLSPVRAIKLVEHIRDSLSADYPDKKETFEKNAAAYIEKLQSLDKAYAEGLSQAKQKSFVTQHAAFNYLALDYGLKQVAISGLSPDAEPSAARLAELTEYVKKNKIAYIYFEENASQALANTLSKEAGVKTDVLNPLESLTEEDTKDGENYISVMEKNLKALKQTTDQEVPAIEPEKAEDTKTVQNGYFEDAAVKDRTLSDYAGNWQSVYPFLEDGTFDQVFDYKAKLTGKMTQAEYKAYYTKGYQTDVTKINITDNTMEFVQGGQSKKYTYKYVGKKILTYKKGNRGVRFLFEATDADAGQFKYVQFSDHNVAPVKAEHFHIFFGGTSQEALFEEMDNWPTYYPDNLSGQEIAQEMLAH

SEQ ID NO: 4994 - protein, 86 aa, Streptococcus pneumoniae
  misc_feature (B) LOCATION 1...86
  hypothetical: YES
GRRLSTESVGWATTTDCIARGLAMVPDVLLFDEPTSALDPEMVGEVLAVMQDLAKSGMTMVIVTHEMGFAREVADRVIFMAERCGC

SEQ ID NO: 4995 - protein, 452 aa, Streptococcus pneumoniae
  misc_feature (B) LOCATION 1...452
  hypothetical: YES
EASVMMKFILDIVSTPAILVALIAILGLVLQKKKLPDIIKGGIKTFVGFLVVSGGAGIVQNSLNPFGTMFEHAFHLSGVVPNNEAIVAVALTTYGSATAMIMFAGMVFNILIARFTRFKYIFLTGHHTLYMACMIAVILSVAGFTSLPLILLGGLALGIIMSISPAFVQKYMVQLTGNDKVALGHFSSLGYWLSGFTGSLIGDKSKSTEDIKFPKSLAFLRDSTVSITLSMAVIYIIVAIFAGSEYIEKEISSGTSGLVYALQLAGQFAAGVFVILAGVRLILGEIVPAFKGISERLVPNSKPALDCPIVYTYAPNAVLIGFISSFIGGLVSMAIMIASGTVVILPGVVPHFFCGATAGVIGNASGGVRGATIGAFLQGILISFLPVFLMPVLGGLGFQGSTFSDADFGLSGIILGMLNQFGSQAGIVIGLVLILAVMFGVSFIKKPSAKEE

SEQ ID NO: 4996 - protein, 66 aa, Streptococcus pneumoniae
  misc_feature (B) LOCATION 1...66
  hypothetical: YES
MESVLESLKQEKDHLEKIIKVVTSGGKFLRLPYQKKSRSISENLKLISQNLDKLSEQVQQTTNQHS

SEQ ID NO: 4997 - protein, 141 aa, Streptococcus pneumoniae
  misc_feature (B) LOCATION 1...141
  hypothetical: YES
RLSVLLMLILRARRYHRMCLICQRIELIKAGQNPYFVKELETGYLVIGDHQYFAGYSLFLAKEHVTELHHLKKETRLRFLEEMSLVQEAVAKAFAAEKMNIELLENGDAHLHWHLFPRRRGDMNGHGLKGRGPVWWVPLKK

SEQ ID NO: 4998 - protein, 91 aa, Streptococcus pneumoniae
  misc_feature (B) LOCATION 1...91
  hypothetical: YES
QAGVVVVDNTSYFRQNPDVPLVVPEVNAHALDAHNGIIACPNCSTIQMMVALERFRQKWGLERIIVLTYQASIQELVWEQFLRHNVNFVKS

SEQ ID NO: 4999 - protein, 72 aa, Streptococcus pneumoniae
  misc_feature (B) LOCATION 1...72
  hypothetical: YES
LPSLDGSQHRHFSGLRQVKINSQLSYYNVFLSLRQLEMISVELDQFPTSLITFSGYIFSYCRFSFYPKFSYY

SEQ ID NO: 5000 - protein, 101 aa, Streptococcus pneumoniae
  misc_feature (B) LOCATION 1...101
  hypothetical: YES
DYSLMDTTLFYGIVIVLAVSPLLLSSFHSIRQQKLLRKQMEQRQEYLASLTSGDEVLLLSGIHGKIISIQDDLVSLQIAKGVVIYVEKESVMGKTKELLFK

SEQ ID NO: 5001 - protein, 460 aa, Streptococcus pneumoniae
  misc_feature (B) LOCATION 1...460
  hypothetical: YES
YNSFMNKKRTVDLIHGPILPSLLSFTFPILLSNIFQQLYNTADVLIVGRFLGQESLAAVGATTAIFDLIVGFTLGVGNGMGIVIARYYGARNFTKIKEAVAATWILGALLSILVMLLGFLGLYPLLQYLDTPAEILPQSYQYISMIVTCVGVSFAYNLFAGLLRSIGDSLAALGFLIFSALVNVVLDLYFITQLHLGVQSAGLATIISQGLSAVLCFYYIRKSVPELLPQFKHFKWDKSLYADLLEQGLAMGLMSSIVSIGSVILQSSVNTFGAVIISAQTAARRIMTFALLPMTAISASMTTFASQNLGAKQPDRIVQGLRIGSRLSISWAVFVCIFLFFASPALVSFLASSTDGYLIENGSLYLQISSTFYPILSLLLIYRNCLQGLGQKILPLVSSFIELIGKIVFVVLIIPWAGYKGVILCEPLIWVAMTVQLYFSLFRHPLIKEGKAILATKVQS

SEQ ID NO: 5002 - protein, 295 aa, Streptococcus pneumoniae
  misc_feature (B) LOCATION 1...295
  hypothetical: YES
INSFRATKGKNSMATIQWFPGHMSKARRQVQENLKFVDFVTILVDARLPLSSQNPMLTKIVGDKPKLLILNKADLADPAMTKEWRQYFESQGIQTLAINSKEQVTVKVVTDAAKKLMADKIARQKERGIQIETLRTMIIGIPNAGKSTLMNRLAGKKIAVVGNKPGVTKGQQWLKTNKDLEILDTPGILWPKFEDETVALKLALTGAIKDQLLPMDEVTIFGINYFKEHYPEKLAERFKQMKIEEEPSVIIMDMTRALGFRDDYDRFYSLFVKEVRDGKLGNYTLDTLEDLDGND

SEQ ID NO: 5003 - protein, 652 aa, Streptococcus pneumoniae
  misc_feature (B) LOCATION 1...652
  hypothetical: YES
TSLVKGVRLMNKRKVSLEDFYKWYSLNKEELLNKATVGEKFNDKLKEEFLQEWPLDRILTMSIDEYVIGKGQQNKSLCYALEKGKYKNLFLGISGGSASKFGIYWNKKTNKYKDQANNEISELDQRFSKLKSDLYEIIKEGIRFNFENPIFDMKRSTNEFIGRSAMVTKLLCIYTEGDPFFGVNINSQKEFWNHFVSQTNQGGPYLQNHKIIELVSKTYPELEPSKLGTMLFEYSKLFMENKEDNSTMDSSNNFSHQLTQSLLKSPNLILRGAPGTGKTYLAKEIAKELTDGNEDQIGFVQFHPSYDYTDFVEGLRPVSNGDGAIEFRLQDGIFKDFCQKSKETQLIGGQDNFDEAWDSYLEYINVAEEKEYITKTSYLSVNSRQNLSVNYDSGVPGWSLPSKYVYELYKDKNYNKQEYYKSGGKTVLETLRKRFGLKDYVSPTEIDTDKKFVFIIDEINRGEISKIFGELFFSIDPGYRGEKGSVSTQYANLHETDEKFYIPENVYIIGTMNDIDRSVDTFDFAMRRRFRFVEVTAEGQVGMLDKELNIHAEEAKIRLRNLNAAIENVQELNSHYHIGPSYFLKLKDVDFDYELLWSDYIKPLLEDYLRGSYDEVETLETLKKAFELTNNEQKDQAVADDNESDENDDADY

SEQ ID NO: 5004 - protein, 296 aa, Streptococcus pneumoniae
  misc_feature (B) LOCATION 1...296
  hypothetical: YES
NQLVSSFLSISSPKYAIIIAKDKEGRPMIKLLALDMDGTLLNEAKEIPQAHIAAIHQAIEKGVKLVLCTGRPLFGVLPYYKKLGLDLQNEYVIVNNGCSTHQTSDWGLVDWQELSPADIEYLYDLAEKSDVQLTLFDESHYFVLGGKPNQVIENDAKLVFSDLTEISLEEATSGKLRMFQGMFLGTKEQTDDFEQRFAEELCQRFSGVRSQPVIYEAMPLGTTKATALSRLAEILKIDSSEIMAMGDANNDIEMLQFAGLGIAMGNASDYVKSLADAVTSSNEEDGVARAIEKYIL

SEQ ID NO: 5005 - protein, 287 aa, Streptococcus pneumoniae
  misc_feature (B) LOCATION 1...287
  hypothetical: YES
HMLVFSEYQTGTIDLALSFYGYEECTPNYSFGPAIRDTYVLHYITKGQGKFYYKGKIVDLKEGDFFLLKPEELTFYQADSKEPWAYYWLGITGGKSPDYFALSQISDQSYLIQSETCHTQTTAKLISDIVRFAQITKSSELAQLHIMGQLHELMFHLGTIAPNQKKKNISSTHQLYLECKRLIDSHYPQSLTIQDLAKELSVHRSYLSSVFKEFNTLSPKEYLLYVRMHRARQLLENTQESIKVIAYSVGFSDPLHFSKAYKQYFNQTPSHTRKEYSQYQLVRKATL

SEQ ID NO: 5006 - protein, 138 aa, Streptococcus pneumoniae
  misc_feature (B) LOCATION 1...138
  hypothetical: YES
PMLVPKRVKHRREFRGKMRGEAKGGKEVAFGEYGLQATTSHWITNRQIEAARIAMTRYMKRGGKVWIKIFPHKSYTAKAIGVRMGSGKGAPEGWVXPVKRGKMMFEIAGVSEEIAREALRLASHKLPVKCKFVKREAK

SEQ ID NO: 5007 - protein, 86 aa, Streptococcus pneumoniae
  misc_feature (B) LOCATION 1...86
  hypothetical: YES
STIVKFNIKKMLKQSEKRLKSSKESNMGLIKTLAKIYGNYFLTVQGVKVMKTIKKADHVVVGLGKLFIADKLMDTARWLIKPEERE

SEQ ID NO: 5008 - protein, 91 aa, Streptococcus pneumoniae
  misc_feature (B) LOCATION 1...91
  hypothetical: YES
HIIVSKALLEITLKSSYQFVHILFQSTIYIPSTMHHNLGNSYSIKIKKQTRKLGTDCSKHRFKVVDRTDEVSSKHCFEVVDTTHIYTTRQR

SEQ ID NO: 5009 - protein, 68 aa, Streptococcus pneumoniae
  misc_feature (B) LOCATION 1...68
  hypothetical: YES
STIVQVLSEVDNLNLVWYTIFVIGYRLRSYGFVRGGETNEPYTRARSYYYSRCYSWNYLVFRLQMARW

SEQ ID NO: 5010 - protein, 84 aa, Streptococcus pneumoniae
  misc_feature (B) LOCATION 1...84
  hypothetical: YES
QWIVGCTTITSVVPNPSIFLVVTDKAGDGTVDTFIGVATVGQVSCPVMEGRVVLTTMAPLDRKAPALFVNFFSKNVGSPGTVIT

SEQ ID NO: 5011 - protein, 131 aa, Streptococcus pneumoniae
  misc_feature (B) LOCATION 1...131
  hypothetical: YES
RRVVMDRNIDQELVSIIIPTHNRYESLIRAVKSCLHQSYKNIEVIIIDDNYSNVNLRNKIIHQFGYTNHRIKLILSNEDLGATNARNIGIKNSRGKYISFLDDDDEYMPDRILKLMACLKKPWNEECSSSL

SEQ ID NO: 5012 - protein, 152 aa, Streptococcus pneumoniae
  misc_feature (B) LOCATION 1...152
  hypothetical: YES
AEXVGVGVGRALPTLXGMNQVLKVLSEVGIQKIMFFLXVLFYGNNCIDKPVIEDTXFDPVNPYAETKLMGERMIYWMANRYDWKYVIFRYFNVAGAEMDASNGLRVKNPTHIIPNINKTALGQNDSLKIFGDDYDTRDGSCIRDYIYVLDLA

SEQ ID NO: 5013 - protein, 261 aa, Streptococcus pneumoniae
  misc_feature (B) LOCATION 1...261
  hypothetical: YES
HGSVCGGSASTLQGRDFLSSYLGGRTAHGYLVQHGACLPCPRSETQLSPTSASARLHREGGALLMSYQDYINCSREALLEKMAELLPEKRLTHCLGVERAAMELAQRFGVDVEKASLAGLLHDYAKKLSDQEFLDLIDRYQLDPDLKNWGNNVWHGMVGIYKIQEDLDLHDSEILRAIEVHTVGAGQMTDLDKVIYVADYIEHNRAFPGVDVAREIASLSLNKAVAYETARTVEYLAHQGFPIYPQTLETYNAFVHYLKED

SEQ ID NO: 5014 - protein, 357 aa, Streptococcus pneumoniae
  misc_feature (B) LOCATION 1...357
  hypothetical: YES
ILPVRLPRCVRAAPGARRRRGAPVRRTSPVAAGVPAVLAGTAAGARAPLRGAARSRRSPVPGRLPFPAAVLPAAARLPGAGGRAWPPGRRETAVALRPVASRGSPVAPPGARCVPAPRREPVAIGGPGRARPGPGAGVGRATAAPGSCAEAPQLRAGLCVIAGFVGTLAQPLADRRDLLDGLVGFAVLAFLVFADLQQQLDFLVLRQPFAQASGRMALIVVDDLVHDPAHRVQHVDGRIVVGGGQLARQHDVPVENRAGLVGHRLAHVVAFHQHGVERGDRAPLGLPGTLHQAWQRGEHRWRIAAAGGRFTGRQADFALGPGEAGQRVHQQQDAASLVADILGDAGGDEIGIELYTT

SEQ ID NO: 5015 - protein, 525 aa, Streptococcus pneumoniae
  misc_feature (B) LOCATION 1...525
  hypothetical: YES
YFAVVGGQIMTPEQLKASILQRAMEGKLVPQNPNDEPASELLKRIKAEKEKLISEGKIKRDKKETEIFRGDDGKHYGKFADGSTQEIDVPYDIPDTWEWVRIKSIYWNFGQNKPEKSFRYIDTSSIDRKKNIINYKNLQYLSPEQAPSRARKLVSQNSVLFSTVRPYLKNIAVVRELKEYLIASTAFIVLDTLLNETYLKYYLLSDNFINRVNNKSTGTSYPAINDYNFNLLLIALPPLSEQQRIVEAIESALEKVDEYAESYNRLEQLDKEFPDKLKKSILQYAMQGKLVEQDPNDESVEVLLEKIRAEKQKLFEEGKIKKKDLDISIVSQGDDNSYYEEVPCEIPESWEWVRLNDITSYIQRGKSPKYSNIPIYPVIAQKCNQWSGFSIDLARFIDPETVHSYQKERLLRDGDLMWNSTGLGTLGRLAIYHENKNPYGWAVADSHVTVIRVLSGVINCHFIYNFLSSPIVQSVIEEKASGSTKQKELLTKTIKEYLIPLPPLPEQSRIVDKIEQFFAHIDALI

SEQ ID NO: 5016 - protein, 531 aa, Streptococcus pneumoniae
  misc_feature (B) LOCATION 1...531
  hypothetical: YES
YFAVVGGQIMTPEQLKASILQRAMEGKLVPQNPNDEPASELLKRIKAEKEKLISEGKIKRDKKETEIFRGDDGKHYGKFADGSTQEIDVPYDIPDTWEWVRFSTLVEIVRGGSPRPIKDYLTSEVDGINWIKIGDTEKGEKYINNVKEKIKKSGLNKTRFVKKGTFLLTNSMSFGRPYILNVDGAIHDGWLAISNYENSLNKDYLFYILSSNVVYSQFLSLISGAVVKNLNSDKVASILIPLPPLSEQQRIIEAIESALEKVDEYAESYNRLEQLDKEFPDKLKKSILQYAMRGKLVEQDPNDESVEVLLEKIRAEKQKLFEEGKIKKKDLDISIVSQGDDNSYYGNKDETTSYPIYKIPEAWRYIKFASLVNFRIGKTPPRSEATFWGTEIPWVSISDMPISGYVTNTRESISKLALKSKKIDISPKGTLLMSFKLSIGKVAILDIPATHNEAIISIFPYANKENIIRDYLMIFLPLISTLGDSKDAIKGKTLNSTSISELLIPISNHEEMKRIIFKVDLLFQKVSQLFE

SEQ ID NO: 5017 - protein, 74 aa, Streptococcus pneumoniae
  misc_feature (B) LOCATION 1...74
  hypothetical: YES
NMAVKISGVLKDGTGKPVQNCTIQLKARRNSTTVVVNTVGSENPDEACFFILSWHYKKALLINLLQRTGHYQSK

SEQ ID NO: 5018 - protein, 62 aa, Streptococcus pneumoniae
  misc_feature (B) LOCATION 1...62
  hypothetical: YES
FLGLCIACMGVSVGEGLLMTGLFKSVARQPDNASEFRSLMFLGVAFIEGTFFVTLVFSFIIK

SEQ ID NO: 5019 - protein, 344 aa, Streptococcus pneumoniae
  misc_feature (B) LOCATION 1...344
  hypothetical: YES
RQGFGADIDVTGEIVFNTGMTGYQESITDQSYNGQILTFTYPLVGNYGINRDDYESIIPTCKGVVVFEEARRASNWRNQMTLDEFLKAKKIPGISGIDTRALTKIIRKHGTMRATLTHVGDSMDHVTDQLQATVLPTDNIKQVSTKTSYPAPGVGLSVVLVDFGLKHSILRELSKRNCNVTVVPYSTTAEEILHLNPDGVMLSNGPGNPEDVPQALDMIRGVQGKIPIFGICMGHQLFAMANGAKTYKMKFGHRGFNHAVREIATGRVDFTSQNHGYAVSREDLPEHLIITHEEINDKSVEGVRHRYQPAFSVQYHPDAAPGPHDASYLFDEFIEMMEIFKQSN

SEQ ID NO: 5020 - protein, 94 aa, Streptococcus pneumoniae
  misc_feature (B) LOCATION 1...94
  hypothetical: YES
TCQVCNKTNIKNKKEVFVMNTKKMSQFEIMDTEMLACVEGGGCNWGDFAKAGVGGGVARGLQLGIKTRTWQGAATGAAGGAILGGVAYAATCWW

SEQ ID NO: 5021 - protein, 104 aa, Streptococcus pneumoniae
  misc_feature (B) LOCATION 1...104
  hypothetical: YES
SFQVLMKVKIARAANPGFTIGKATLQKVRISPQPSILADSSNSVGIFSLNCFMRKTPNGHPIKGKITAQRVSWIPMKLTIRTNGTRTTCFGSAIAAIKIANRMR

SEQ ID NO: 5022 - protein, 635 aa, Streptococcus pneumoniae
  misc_feature (B) LOCATION 1...635
  hypothetical: YES
KKQVYTVFADSIKDELDYTNFKEKAQLACVVYTMCGIVGVVGNTNATDILIQGLEKLEYRGYDSAGIFVLDGADNHLVKAVGRIAELSAKTAGVEGTTGIGHTRWATHGKPTEDNAHPHRSETERFVLVHNGVIENYLEIKEEYLAGHHFKGQTDTEIAVHLIGKFAEEEGLSVLEAFKKALHIIRGSYAFALIDSENPDVIYVAKNKSPLLIGLGEGYNMVCSDAMAMIRETNQYMEIHDQELVIVKADSVEVQDYDGNSRERASYTAELDLSDIGKGTYPYYMLKEIDEQPTVMRKLIQAYTDDAGQVVVAPAIIKAVQDADRIYILAAGTSYHAGFASKKMLEELTDTPVELGISSEWGYGMPLLSKKPLFIFISQSGETADSRQVLVKANEMGIPSLTVTNVPGSTLSREANYTMLLHAGPEIAVASTKAYTAQIAALAFLAKAVGEANGNAKAQAFDLVHELSIVAQSIESTLSEKETIEAKVRELLETTRNAFYIGRGQDYYVAMEASLKLKEISYIQCEGFAAGELKHGTIALIEEGTPVLALLSDPVLANHTRGNIQEVAARGAKVLTIAEENVAKDTDDIVLTTVHPYLSPISMVVPTQLVAYFATLHRGLDVDKPRNLAKSVTVE

SEQ ID NO: 5023 - protein, 167 aa, Streptococcus pneumoniae
  misc_feature (B) LOCATION 1...167
  hypothetical: YES
KTGFTREISNYLVKTLEGFGYQPVRTAKGGVNVTIKGQNDEQHRYVTAHVDTLGAIVRAVKPDGRLKLDRIGGFPWNMIEGENCTVHVASTGQKVSGTILIHQTSCHVYKDAGTAERTQDNMEVRLDVKVSNEKETRALGIEVGDFISFDPRTVVTDTGFYQVSSFG

SEQ ID NO: 5024 - protein, 144 aa, Streptococcus pneumoniae
  misc_feature (B) LOCATION 1...144
  hypothetical: YES
EVKVLAKPTRKRRVKKNIESGIAHIHATFNNTIVMITDVHGNAIAWSSAGALGFKGSRKSTPFAAQMASEAAAKSAQEHGLKSVEVTVKGPGSGRESAIRALAAAGLEVTAIRDVTPVPTQWCSSSKTSPCIIIALHCFSFKRE

SEQ ID NO: 5025 - protein, 193 aa, Streptococcus pneumoniae
  misc_feature (B) LOCATION 1...193
  hypothetical: YES
RLKVFSITSVKPGEGKTTTSTNIARAFARAGYKTLLIDADMRNSVMSGVFKSRERITGLTEFLSGTTDLSQGLCDTNIENLFVIQAGSVSPNPTALLQSRNFSTMLETVRKYFDYIVVDTAPVGVVIDAAIITQKCDASILVTKAGETKRRDIQKAKEQIEQTGKPCLGVVLNKFDTSVDEYGSYGSYGKKKK

SEQ ID NO: 5026 - protein, 157 aa, Streptococcus pneumoniae
  misc_feature (B) LOCATION 1...157
  hypothetical: YES
KKKVKNYKGVPMIPQEMWNKYKQINPLIGDEIDAWAFGVEPDLLADLVFKGEKTATASAYDLYVLEDEPLPQVGTFDIILDSQNQSVCIVEITKVSVELFNQVSAQHAFKEGEGDKSLAYWRQVHEDFFTDCLGEVGLTFTSESKVVLEEFRKVYPL

SEQ ID NO: 5027 - protein, 255 aa, Streptococcus pneumoniae
  misc_feature (B) LOCATION 1...255
  hypothetical: YES
KEKVSMSKEIKFSSDARSAMVRGVDILADTVKVTLGPKGRNVVLEKSFGSPLITNDGVTIAKEIELEDHFENMGAKLVSEVASKTNDIAGDGTTTATVLTQAIVREGIKNVTAGANPIGIRRGIETAVAAAVEALKNNAIPVANKEAIAQVAAVSSRSEKVGEYISEAMEKVGKEGVITIEESRGMETELEVVEGMQFDRGYLSQYMVTDSEKMVADLENPYILITDKKISNIQEILPLLESILQEHCSIWDYAG

SEQ ID NO: 5028 - protein, 475 aa, Streptococcus pneumoniae
  misc_feature (B) LOCATION 1...475
  hypothetical: YES
WRKVMTIFPDDFLWGGAVAANQVEGAYNEDGKGLSVQDVLPKGGLGEATENPTEDNLKLIGIDFYHKYKEDISLFSEMGFNVFRTSIAWSRIFPKGDEEEPNEAGLKYYDELFDELHAHGIEPLVTLSHYETPLYLARKYHGWVDRRMIHFYEKFARTVLERYKDKVKYWLTFNEVNSVLELPFTSGGIDIPKENLSKQELYQAIHHELVASSLVTKIAREINSEFKVGCMVLAMPAYPMTPNPKDVWATHEYENLNYLFSDVHVRGYYPNYAKRYFKENDINIEFAAEDAELLKNYTVDFLSFSYYMSVTQSAIPTQYNSGEGNIIGGLVNPYLESSEWGWQIDPIGLRIILNRYYDRYQIPLFIVENGLGAKDQLIKDELNNLTVQDDYRIQYMKEHLLQVAEALQDGVEIMGYTSWGCIDCVSMSTAQLSKRYGLIYVDRNDDGNGTFNRYKKMSFTWYKGVIESNGDSLFK

SEQ ID NO: 5029 - protein, 236 aa, Streptococcus pneumoniae
  misc_feature (B) LOCATION 1...236
  hypothetical: YES
KVEVAGDGTATITFPDGSVVTILGKDTVQQSAKGESVTQEATPEYKPETTPGGDKGGNTGNSDANANAGGGSQAGGSAHTGSQNSAQSQASKQLATEKESAKNAIEKAAKDKQDEIKGAPLSDKEKAELLARVEAEKQAALKEIENAKTMEDVKEAETIGVQAIAMVTVPKRPVAPKTTSAPQATAGTMQDVTYQSPAGKQLPNTGSASSAALASLGLVVATSGFALLGRKTRRRK

SEQ ID NO: 5030 - protein, 74 aa, Streptococcus pneumoniae
  misc_feature (B) LOCATION 1...74
  hypothetical: YES
WVEVTLVQSGVTISRTPLSSEATVMIDATEVKINRPKKELANYSCKKMPRYEGSSDCHKSRENCFFGYHCELLS

SEQ ID NO: 5031 - protein, 328 aa, Streptococcus pneumoniae
  misc_feature (B) LOCATION 1...328
  hypothetical: YES
YNEVLEKQVSFAWKGKIMSEKNFYITTPIYYPSGKLHIGSAYTTIACDVLARYKRLMGYDVFYLTGLDEHGQKIQQKAEEAGITPQAYVDGMAVGVKELWQLLDISYDKFIRTTDDYHEKVVAQVFERLLAQDDIYLGEYSGWYSVSDEEFFTESQLAEVFRDEAGNVTGGIAPSGHEVEWVSEESYFLRLSKYQDRLVEFFKAHPEFITPDGRLNEMLRNFIEPGLEDLAVSRTTFTWGVPVPSNPKHVVYVWIDALLNYATALGYAQDEHGNFDKFWNGTVFHMVGKDILRFHSIYWPILLMMLDVKLPDRLIAPWLFVHERRKNV

SEQ ID NO: 5032 - protein, 113 aa, Streptococcus pneumoniae
  misc_feature (B) LOCATION 1...113
  hypothetical: YES
TFEVCYNKENKNKRFIMTKLYGSLEAGGTKFVCAVGDENFNVVEKTQFPTTTPIETIDKTIESSQNSITFLVLQLVHLGRLILTKTQKLMALSRRLQNQTGQMWTCLVPFVAP

SEQ ID NO: 5033 - protein, 142 aa, Streptococcus pneumoniae
  misc_feature (B) LOCATION 1...142
  hypothetical: YES
WTEVIEFNARFGDPETQLILPRLTSDFAQNITDILDSKEPNITWTDKGVTLGVVVASKGYPLDYSKGVELPVKTDGDIITYYAGAKFAENSRALLSNGGRVYMLVTTADTVKEAQASIYQELSQQKIEGLFYRTDIGSKAIK

SEQ ID NO: 5034 - protein, 604 aa, Streptococcus pneumoniae
  misc_feature (B) LOCATION 1...604
  hypothetical: YES
AREVVLGYDLSEEEEQILSRQMNLVLSYEKESFEDLHLLDLRLATVEQTASSKLLQYVHRTQMRELNHLKPVIRYEIKDFLQMDYATKASLDLVENARSGKKQGSLFWLLDETKTAMGMRLLRSWIHRPLIDKERIVQRQEVVQVFLDHFFERSDLTDSLKGVYDIERLASRVSFGKTNPKDLLQLATTLSSVPRIRAILEGMEQPTLAYLIAQLDAIPELESLISAAIAPEAPHVITDGGIIRTGFDETLDKYRCVLREGTSWIAEIEAKERENSGISTLKIDYNKKDGYYFHVTNSQLGNVPAHFFRKATLKNSERFGTEELARIEGDMLEAREKSANLEYEIFMRIREEVGKYIQRLQALAQGIATVDVLQSLAVVAETQHLIRPEFGDDSQIDIRKGRHAVVEKVMGAQTYIPNTIQMAEDTSIQLVTGPNMSGKSTYMRQLAMTAVMAQLGSYVPAESAHLPIFDAIFTRIGAADDLVSGQSTFMVEMMEANNAISHATKNSLILFDELGRGTATYDGMALAQSIIEYIHEHIGAKTLFATHYHELTSLESSLQHLVNVHVATLEQDGQVTFLHKIEPGPADKSTVSMLPRLLACQQTF

SEQ ID NO: 5035 - protein, 123 aa, Streptococcus pneumoniae
  misc_feature (B) LOCATION 1...123
  hypothetical: YES
LGEVMRLIYLIIGFLSLALAIVGVVLPLLPTTPFLLLSIACFSRSSKRFEDWLYHTKLYQTYVADFRETKSITRERKKKIIVSIYVLMGISIYFAPLLPVKIGLGALTIFITYYLFKVIPDKE

SEQ ID NO: 5036 - protein, 84 aa, Streptococcus pneumoniae
  misc_feature (B) LOCATION 1...84
  hypothetical: YES
KLRVVRLAIMLRDLDLYKVIFEGNYRATAGREEMKEAILEYQANPAALKDLKEKAKNISREYSEEHLLQIWLDFYEKQAALGRK

SEQ ID NO: 5037 - protein, 85 aa, Streptococcus pneumoniae
  misc_feature (B) LOCATION 1...85
  hypothetical: YES
NRRVMGIEPTHARATIWCVNHFTTPAIILLTRAVGIEPTLKVLETLVLPLNYARKMEGEGFEPPNPKERIYSPPRLASSLPFQNI

SEQ ID NO: 5038 - protein, 121 aa, Streptococcus pneumoniae
  misc_feature (B) LOCATION 1...121
  hypothetical: YES
IFRVHYRFWWELRPRIWCDNSMMRNEFRERVEQLLQQKEINENSELSHLFRLAIQNLDRNEKYQSVMANLSQGLSLYLMTHHYQAPKSVIDFGLWIAKAPSQERGRLAFLQMLAQTLQGFR

SEQ ID NO: 5039 - protein, 445 aa, Streptococcus pneumoniae
  misc_feature (B) LOCATION 1...445
  hypothetical: YES
GERVMDLFGFGTVIVHFLIISHSYHFICKGQINRKELFVFGAYTLLTEIVFDFPLYILYLDGLGIERFLFPLGLYSYFRWMKQYERDRGLFLSLLLSLLYESTHNFLSVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 5040 - protein, 158 aa, Streptococcus pneumoniae
  misc_feature (B) LOCATION 1...158
  hypothetical: YES
KRRVRLSALFYGCKKVHLNNLSSVDSEELFQFYRERGNAENFIKERKAGFFGDKTDSSTMIKNEVRMMMGCLAYNLYLFLKQLAGDEVKALTIKRFRRLFLHIAGKYVSTARRHILKFSSLYAYSKQFQALFDTICQINLILPVPYRARGQGKTCLTE

SEQ ID NO: 5041 - protein, 87 aa, Streptococcus pneumoniae
  misc_feature (B) LOCATION 1...87
  hypothetical: YES
MGRVDRASVERVDRPDLVLSIDFRFFVNYSWFVKKLIFGEEDCYLLHFYVQSYSGLMLGKYTVTAKTFLEVALIYLIYLCKFYVILL

SEQ ID NO: 5042 - protein, 629 aa, Streptococcus pneumoniae
  misc_feature (B) LOCATION 1...629
  hypothetical: YES
VERVVYMKIENKNVRRNFFWGDGRFYTTDIVNKRAGVMIENVSKEEFTITLENGIRLSSNHFSAIVREEGDTRIQVSFVCPSIRLRLIFESRDDVLSKQLVLESSTEVIKSVEVESFEFETEDNIFYPKRQDCIKEMANFSGHYVELGQPVYANSLFLGMEFPMSENKVDGRHYVSRYYLGTVVNQEKSLWSCIIGGACSYKKEEIQEAFFEYVEGIAQPSYFRKQYNSWYDHMTDITEEGILKSFSEIRDGFENHGVHLDAYVVDDGWTNYQSVWEFNHKFPNGLRNIKHLVNGFGSSLGLWIGPRGGYNGTEIIMSDWLEAHPELNIGSKNLISNDVNVADFNYLNQMKKKMLEYQKEFDISYWKIDGWLLQPDKPDKSGPHGMYTMTAVYEFLIQLLIDLRKERGGKDCWLNLTSYVNPSPWFLQWVNSLWIQISQDVGFTENAGNDINRMITYRDSQYQEFLEKREIQLPMWSLYNHEPIYAVSANTWYMDHQMFASIPDFEAYLLFISTRGNAFWEFHYSFDMFDEERWKANARAVKWIEENYQTLKYSKKIGGSPEKFEIYGYKCHNQKTSTEILSLRNPAQIKQKIKIENLSIENFTRVIGDFTIQEDEIELAPYSIVILKK

SEQ ID NO: 5043 - protein, 295 aa, Streptococcus pneumoniae
  misc_feature (B) LOCATION 1...295
  hypothetical: YES
IERVNLMLQQLVNGLILGSVYALLALGYTMVYGIIKLINFAHGDIYMMGAFIGYFLINSFQMNFFVALIVAMLVTAILGVVIEFLAYRPLRHSTRIAVLITAIGVSFLLENGMVYLVGANTRAFPQAIQTVRYDLGPISLTNVQLMILAISLILMILLQVIVQKTKMGKAMRAVSVDSDAAQLMGINVNRTISFTFALGSALAGAAGVLIALYYNSLEPLMGVTPGLKSFVAAVLGGIGIIPGAALGGFVIGLLETFATAFGMSDFRDAIVYGILLLILIVRPAGILGKNVKEKV

SEQ ID NO: 5044 - protein, 79 aa, Streptococcus pneumoniae
  misc_feature (B) LOCATION 1...79
  hypothetical: YES
SGGVVNVKEYPLYFFSYSMEIKEQTRKLAAGCSKHCFEVVDRTDEVSNHIYGNVTLTWFEEIFEEYYISKGRSKFTPTC

SEQ ID NO: 5045 - protein, 313 aa, Streptococcus pneumoniae
  misc_feature (B) LOCATION 1...313
  hypothetical: YES
EKGVGSLTLRSHSERLMGTTITISLVDEQADIFLQKSFDLLKELEYRFNANSQESELMEINYQAGVSPVTVHPDLFELISLGLEHSLALSSHLNISIGPLIQTWRIGFSDAKVAQPQEIESVLPLINPHGIELDSSTSTVFLKQKGMKIDLGCLAKGYSADKVAQFLRKEGVTSALINLGGNILTIGKNQARGDNPWQIGIQDPANPRGNHLMTIPVVNKSVVTSGIYERHLTVDGQDYHHIFDSQTGYPVETELASLTIISDKSVDGEIWTTRLFGERPASILWQVESLEGIEVILIDKEGHLSCSSGIPTL

SEQ ID NO: 5046 - protein, 68 aa, Streptococcus pneumoniae
  misc_feature (B) LOCATION 1...68
  hypothetical: YES
KGGVFMKSFKDFRESLTAEDMQAISAKANEATKQIDHTDGLQLGKVSGLTSVITTIELLEKYHEWLHS

SEQ ID NO: 5047 - protein, 124 aa, Streptococcus pneumoniae
  misc_feature (B) LOCATION 1...124
  hypothetical: YES
HSGVKQSGRLFQPEPRNLKAKLFSQVIVRAKHIHSNDFDATSDGSIIFKKVISDDSLCSTFKNSDDIELFKILRNKAHLHLPIETVTPRTVSTSQDIILGRFLKLHSKWKSLSFRMTVEVEMES

SEQ ID NO: 5048 - protein, 108 aa, Streptococcus pneumoniae
  misc_feature (B) LOCATION 1...108
  hypothetical: YES
HSGVKQSGRLFQPEPRNLKAKLFSQAIVRAKHIHSNDFDATSDGSIVAKKVISNDSLCSSLKNSDDIELVKILRNKAHLHLPIETVTTRTVSTSQDIISGRQEKSCLK

SEQ ID NO: 5049 - protein, 108 aa, Streptococcus pneumoniae
  misc_feature (B) LOCATION 1...108
  hypothetical: YES
HSGVKQSGRLFQPEPRNLKAKLFSQVIVRAKHIHSNNFDATSDSSIVAKKVISNDSLCSSLKNSDDIEIVKILRNEAHLHLPIETVTPRTVSTSQDIISGRREKSCSK

SEQ ID NO: 5050 - protein, 108 aa, Streptococcus pneumoniae
  misc_feature (B) LOCATION 1...108
  hypothetical: YES
HSGVKQSGRLFQPEPRNLKAKLFSQAIVRAKHIHSNDFDATSDGSIVAKKVISNDSLCSSLKNSDDIEIVKILRNEAHLHLPIETVTPRTVSTSQDIISGRQEKSCLK

SEQ ID NO: 5051 - protein, 108 aa, Streptococcus pneumoniae
  misc_feature (B) LOCATION 1...108
  hypothetical: YES
HSGVKQSRRLFQPEPRNLKAKLFSQVIVRAKHIHSNDFDATSDGSIIFKKVISDDSLCSTFKNSDDIELFKILRNKAHLHLPIETVTPRTVSTSQDIILGRFLKLHSK

SEQ ID NO: 5052 - protein, 111 aa, Streptococcus pneumoniae
  misc_feature (B) LOCATION 1...111
  hypothetical: YES
HSGVKQSGRLFQPEPRNLKAKLFSQVIVRTKHIHSNNFDATSDNSIVAKKVISNDSLCSTLKNSDDIELVKILRNEAHLSLCKSILIPRHNLRKTRKIMFKVKIIELTNDS

SEQ ID NO: 5053 - protein, 321 aa, Streptococcus pneumoniae
  misc_feature (B) LOCATION 1...321
  hypothetical: YES
NGGVFLKPFKTIEEQIATLKIRGLSITDESKAAKYLLSNNYYNIINGYSKFFQHPGTDTYIDGVTFDEVSSLYTFDKDVKRAILQAILEAEHHIKSITAHRFAEAYPSQKYAYLNTNSYADNKILDVGFIVSKLSKIINTNKRYRGNSIHHYAHTHSDVPIWVLTDYLEFGDLRTIIENLPNSLQNEIARDLVSFISTNIPDFNDVFPPETLISFLKNINEVRNKCAHNNRLLNFRCRSNSTFWETIHNKEILMGDDSRKTVYSTIISLQCFISKAAFNILWNTLRKKVIKLEKKLPSIDINVINQSLGFPNDWHRNEPKV

SEQ ID NO: 5054 - protein, 113 aa, Streptococcus pneumoniae
  misc_feature (B) LOCATION 1...113
  hypothetical: YES
VFLVYLIITVHKLGRVIDETEKTIKTLTSDVDVTLHHTNELLAKVNVLADDINVKVATIDPLFSAVADLSLSVSDLNDHARVLSKKASSAGSKTLKTGASLSALRLASKFFKK

SEQ ID NO: 5055 - protein, 92 aa, Streptococcus pneumoniae
  misc_feature (B) LOCATION 1...92
  hypothetical: YES
LFLVRKYLYHQPSLLQDICWGLRRAVEAIVTIEAMRHNFVPMTAGTSEVSDYIEANVVYGQGLEKEIPYAISNTFGFGGHNAVLAFKRWENR

SEQ ID NO: 5056 - protein, 64 aa, Streptococcus pneumoniae
  misc_feature (B) LOCATION 1...64
  hypothetical: YES
LSLVEYLVWDQGVAGSNPVFPIHGGVAQLARASGSYPGGRGFDPLRRYNDLVGPLAQLVRALGS

SEQ ID NO: 5057 - protein, 84 aa, Streptococcus pneumoniae
  misc_feature (B) LOCATION 1...84
  hypothetical: YES
LRLVIKNIGRNVLNKKYNIVLFLLFIVYLFGYFSISKTLIPIMCVFQVFLIEHIFRIRNRMMQIGEIIIIVASIILFIDSILSL

SEQ ID NO: 5058 - protein, 82 aa, Streptococcus pneumoniae
  misc_feature (B) LOCATION 1...82
  hypothetical: YES
KRLVLSVQAVIRDKLLSEKPSVIAYSMVAIAIQNVNLPLGTSLLVVTVQNVATSSWRKKSVVVASRLFVAKEMTLHHECXAQ

SEQ ID NO: 5059 - protein, 815 aa, Streptococcus pneumoniae
  misc_feature (B) LOCATION 1...815
  hypothetical: YES
PSLVKHKSDRISLHQKDLEITSVEVAGQARPFTVDHDNEALHIELAEAGQVELVLAFSGKITDNMTGIYPSYYTVDGVKKEVLSTQFESHFAREAFPCVDEPEAKATFDLSLRFDQAEGELALSNMPEIDVENRKETGIWKFETTPRMSSYLLAFVAGDLQGVTAKTKNGTLVGVYSTKAHPLSNLDFSLDIAVRSIEFYEDYYGVKYPIPQSLHIALPDFSAGAMENWGLVTYREVYLVVDENSTFASRQQVALVVAHELAHQWFGNLVTMKWWDDLWLNESFANMMEYVCVDTIEPSWNIFEDFQTGGVPLALERDATDGVQSVHVEVKHPDEINTLFDGAIVYAKGSRLMHMLRRWLGDADFAKGLHAYFEKHQYSNTIGSDLWDALGQASGRDVAAFMDSWLEQPGYPVLTVKVENDVLKISQKQFFIGENEDKNRLWVVPLNSNWKGLPDTLETESIEIPGYAALLAENEGALRLNTENTAHYITDYQGDLLEAVLAELETLDNTSKLQIVQERRLLAEAGHISYADLLPVLDKLAKEESYLVVSAVSQVISALERFIDEGTDAETAFKGLVAKLARHNYDRLGFEAKDGESDEDELVRQLAVSMMIRSNDAEARQVASQIFATHKENLAELPAAIRSQVLINEMKHHETKDLLALYLDTYTHATDAVFKRQLTAALAYSTDADNIQNLITSWKDKFVVKPQDLSAWYYQFLAHQATQKTAWSWARENWAWIKAALGGDMSFDSFVILPAHVFKTQQRLAEYKEFFEPQLSDLALSRNIGMGIKEIAARVDLISREKAAVEAVVLQYGNA

SEQ ID NO: 5060 - protein, 314 aa, Streptococcus pneumoniae
  misc_feature (B) LOCATION 1...314
  hypothetical: YES
PGLVCWVLIVFLVAVNSLSDYKTDFRLFEFSKIFGDEEYGFQLSVTVLRYGYTYRLFSFVVDMLNQDMGRNLEVIQRHGALLLVENGQLLYVELPKEGVNVHDFFETSKVRETLLIATRNEGKTKEFRAIFDKLGYDVENLNDYPDLPEVAETGMTFEENARLKAETISQLTGKMVLADDSGLKVDVLGGLPGVWSARFAGVGATDRENNAKLLHELAMVFELKDRSAQFHTTLVVASPNKESLVLNTRPGQVILTLKPKGENGFGYDPLFLVGETGESSAELTLEEKNSQSHRALAVKKLLEVFPSWQSKPSL

SEQ ID NO: 5061 - protein, 68 aa, Streptococcus pneumoniae
  misc_feature (B) LOCATION 1...68
  hypothetical: YES
FLLVGKELVSVNSLKASQNQLCNLGGATVSLTLPYQTVPTQGFIMLGSLHSINHLLSTTILGMVQAGD

SEQ ID NO: 5062 - protein, 218 aa, Streptococcus pneumoniae
  misc_feature (B) LOCATION 1...218
  hypothetical: YES
DSMVKVATQTPIISLFLLILSLETSFIPSIALNLSVVAFCILFMLYYRRFKMLAWMIILAILPSFANYWAVQLHGDASQAVMLGTRAFVTVCIGLVFVSSISLKELLLYLAQKGLSRSWSYALIVVFNSFPLIQQEIKSLKEACLLRGQELYFWSPLIYSKVLMTVFRWRHLYLRALSAHGYDEHAQLKNSYRTFYIPKKTKLIYLLFFLLLQTSLFL

SEQ ID NO: 5063 - protein, 219 aa, Streptococcus pneumoniae
  misc_feature (B) LOCATION 1...219
  hypothetical: YES
STMVGEILCHVQNILGKQTLKPLSRLKIKSQFKKARKRFKYSRRFRKVRLMYQDEAGFSRISKLGSCWSPIGVDPHVHSHYIREFRYCYGAVDAYTGESFFLIAGRCNTEWMNAFLEELSQAYPDDYLLLVMDNAIWHKSSILKIPTNIGFAFIPPYTPEMNPIEQVWKEIRKRGFKNKAFRILEDVMNQLQDVIQGLEKEVIKSIVNRRWTRMLFESR

SEQ ID NO: 5064 - protein, 98 aa, Streptococcus pneumoniae
  misc_feature (B) LOCATION 1...98
  hypothetical: YES
SAMVGEILCHVQNILGKQTLKPLSRLKIKSQFKKKRKRFKTSRRFHKVRLMYQDEAGFGRISKLGSCWSPIGVGPHVHSHYIREFRYCYGPIQANHFS

SEQ ID NO: 5065 - protein, 219 aa, Streptococcus pneumoniae
  misc_feature (B) LOCATION 1...219
  hypothetical: YES
SAMVGEILCHVQNILRKQTLKPLSRLKIKSQFKKKRKRFKTSRRFHKVRSMYQDEAGFGRISKLGSCWSPIGVGPHVHSHYIREFRYCYGAVDAHTGESFFLRAGGCNTEWMNAFLEELSQAYPDDYLLLVMDNAIWHKSSTLKIPTNIGFAFIPPYTPEINPVEQVWKEIRKRGFKNKAFRTLEDVMNQLQDIIQGLEKEVIKPIVNRRWTRMLFESR

SEQ ID NO: 5066 - protein, 62 aa, Streptococcus pneumoniae
  misc_feature (B) LOCATION 1...62
  hypothetical: YES
ALMVPLQSLIFVLGVQTILKWAKGLLSQMKNFKRWWMPLKATNTLRKSLQTASALPCRMYGY

SEQ ID NO: 5067 - protein, 1262 aa, Streptococcus pneumoniae
  misc_feature (B) LOCATION 1...1262
  hypothetical: YES
EKMVYSIRSLKNGTGSVLIGASLVLLAMATPTISSDESTPTTNEPNNRNTTILAQPLTDTAAGSGKNESDISSPRNANASLEKTEEKPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKTYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSPESTAEEKPDSTPSKPEHQDPAPEARPDSTKPDAKVADAENKPSQATADSQAEQPAQEAQASSVKEAVQNESVENSSKKNIPATPDRQAELPNTGIKNENKLLFAGISLLALLGLGFLLKNKKEN

SEQ ID NO: 5068 - protein, 231 aa, Streptococcus pneumoniae
  misc_feature (B) LOCATION 1...231
  hypothetical: YES
GEMVEAMRAGQFLHLRVPDDAHLLRRPISISSIDKANKQCHLIYRIEGAGTAIFSTLSQGDTLDVMGPQGNGFDLSDLDEQNQVLLVGGGIGVPPLLEVAKELHERGVKVVTVLGFANKDAVILKTELAQYGHVFVTTDDGSYGIKGNVSVVINDLNSQFDAVYSCGAPLMMKYINQTFDDHPRAYLSLESRMACGMGACYACVLKVPENETVSQRVCEDGPVFRTGTVVL

SEQ ID NO: 5069 - protein, 434 aa, Streptococcus pneumoniae
  misc_feature (B) LOCATION 1...434
  hypothetical: YES
NQMVMWSYCIARIGGRMESLLILLLIANLAGLFLIWQRQDRQEKHLSKSLEDQADHLSDQLDYRFDQARQASQLDQKDLEVAVSDRLQEVRIELHQGLTQVRQEMTDNLLQTRDKTDQRLQALQESNEQRLEQMRQTVEEKLEKTLQTRLQASFETVSKQLESVNRGLGEMQTVARDVGALNKVLSGTKTRGILGELQLGQIIEDIMTPAQYEREYATVENSSERVEYAIKLPGQGDQEYVYLPIDSKFPLADYYRLEEAYETGDKDEIERCRKSLLASVKRFAKDIKSKYIAPPRTTNFGILFVPTEGLYSEIVRNPVFFDDLRREEQIIVAGPSTLSALLNSLSVGFKTLNIQKSADHISKTLASVYTEFGKFGGILVQAQKHLQHASGNIDELLNRRTIAIERTLRHIELSEGEPALDLLYFQENEEEYED

SEQ ID NO: 5070 - protein, 88 aa, Streptococcus pneumoniae
  misc_feature (B) LOCATION 1...88
  hypothetical: YES
NRMVKWLSMNGLMVDVIMLALTEFGRKVKQVQFLLVMIAIVNISAALGKAKSYNSLFHMSKKRMYRQLTSDFDKFSNDAAQYAIDHLD

SEQ ID NO: 5071 - protein, 377 aa, Streptococcus pneumoniae
  misc_feature (B) LOCATION 1...377
  hypothetical: YES
KRMVPRVNAPSGVFGMWFSFYLRETDGGNMSTIEEQLKALREETLASLKQITAGNEKEMQDLRVSVLGKKGSLTEILKGMKDVSAEMRPIIGKHVNEARDVLTAAFEETAKLLEEKKVAAQLASESIDVTLPGRPVATGHRHVLTQTSEEIEDIFIGMGYQVVDGFEVEQDYYNFERMNLPKDHPARDMQDTFYITEEILLRTHTSPVQARAMDAHDFSKGPLKMISPGRVFRRDTDDATHSHQFHQIEGLVVGKNISMADLQGTLQLIVQKMFGEERQIRLRPSYFPFTEPSVEVDVSCFKCGGEGCNICKKTGWIEIMGAGMVHPRVLEMSGIDATVYSGFAFGLGQERVAMLRYGINDIRGFYQGDVRFSEQFK

SEQ ID NO: 5072 - protein, 117 aa, Streptococcus pneumoniae
  misc_feature (B) LOCATION 1...117
  hypothetical: YES
TIVVNTSHLSNCPKCNSEYVYEDGALLVCPECAHEWNPAEVAEVEEGLVAIDANGNKLADGDIVTLIKDLKVKGAPKDLKQGTRVKNIRIVEGDHNIDCKIDGFGAMKLKSEFVRKI

SEQ ID NO: 5073 - protein, 133 aa, Streptococcus pneumoniae
  misc_feature (B) LOCATION 1...133
  hypothetical: YES
RFVVKRLGYEHSMARHLGAVYNLPHGVCCAMLLPVIERENAKRVPEAFRNVAKALGLHVEGKSDQECADYAIVEIEKLSETVGIPKKLTELGIEEKDFDFEYLSKNALIDACAPGNPFMPTLEETIAFYKELF

SEQ ID NO: 5074 - protein, 297 aa, Streptococcus pneumoniae
  misc_feature (B) LOCATION 1...297
  hypothetical: YES
NVVVQEKIIVIVGPTAVGKTALAIEVAKRFNGEVVSGDSQQVYRGLDIGTAKASPEEQAAVPHHLIDVREITESYSAFDFVSEAKMTIEGIHNRGKLAIIAGGTGLYIQSLLKGYHLGGETPHEEILAYRASLEPYSDEELAHLVEQAGLEIPQFNRRRAMRALEIAHFGQDLENQEILYEPLIICLDDERSQLYERINHRVDLMFEAGLLDEAKWLFDHSPNVQAAKGIGYKELFPYFRGEQTFEEARESLNQATRRFAKRQLTWFRNRMLVTFYHIGESGVQDRILSQIEESLDD

SEQ ID NO: 5075 - protein, 60 aa, Streptococcus pneumoniae
  misc_feature (B) LOCATION 1...60
  hypothetical: YES
FLVVKLFDLCYSEYAWDSLSKWFIKQFYFTKTIVTMQKSNGKSVAFFGYKRLLSQTLFFV

SEQ ID NO: 5076 - protein, 336 aa, Streptococcus pneumoniae
  misc_feature (B) LOCATION 1...336
  hypothetical: YES
ESSVVSSLSYFSGEGDEKMQTKSKHTKLFWILIILAIGACLLYFWPITHLSAFAWKLRSQKIIVYLLVAIATGISTISFQTLTENRFLTPSILGIESFYVLLQTLLLVFESKFLQLGKSPILEFLVLLLVQSLFFLALQGYLKTLMKQDLVFILLICLALRSLFRNISTFLQVLMDPNEYDKLQNSLFASFQHLNTSILAIGSLIILALTIFFFRKAVVLDVLHLQRETAQILGLDVEKEQKELLWGIVLLTSTATALVGPMAFFGFMLANLTYLIVKDYQHKLLFIVAILIGFISLTLGQALIERVFALEIRISMIIESVGGFLFFILLYRRARQ

SEQ ID NO: 5077 - protein, 61 aa, Streptococcus pneumoniae
  misc_feature (B) LOCATION 1...61
  hypothetical: YES
CIPVNESFGLILSENALQTDVNVALPCVWLLNTSVLSTTSKQCFEQSAASFLVCSLIFIEY

SEQ ID NO: 5078 - protein, 148 aa, Streptococcus pneumoniae
  misc_feature (B) LOCATION 1...148
  hypothetical: YES
VETVKRLRKYPKIEIVSHLINGLPGETHEMMVENVRRCVTNNDIQGIKLHLLHLMTNTRMQRDYHEGRLQLMSQDEYVRVICDQLEIIPKHIVIHRITGDAPRDMLLGPMWSLNKWEALNSIEMEMRRRGSVQGCKAVKQEFENEKTT

SEQ ID NO: 5079 - protein, 94 aa, Streptococcus pneumoniae
  misc_feature (B) LOCATION 1...94
  hypothetical: YES
EKTVYDQTIHRVAEIVQNEDLYKKGLNVELAHQQIKGFFEAEFKNRINGVLNTKIKNSTLNRVNKKTIHQSNKNSMINLKQKQRKMLKNKAILC

SEQ ID NO: 5080 - protein, 294 aa, Streptococcus pneumoniae
  misc_feature (B) LOCATION 1...294
  hypothetical: YES
RSQVRLLPAIGLISQERQRQVIALLLVEVMRIIRMLGLVLWGVYQLHPAPAVQVVVLAIAVTQVLHDLLQGRDDNSLNEVANQWIATFFLSCYNKGMNQYQKKIVNGKIYSLLSGLIWGICGILGKYFFTHYQVSSGWITSMRLTLAGSLVLIWSAIQLKSQVLDIWRDKKNYLPFLAYAILGIFSVQYFFYLCVEYSNATTATILQFISPVFILFYNRLVYQKRASKSAVFYVLVAMLGVCLMATKGDLSQLSMTPLALITGLLSAMGVMFNVILPQPFAKRYGFVLTSWVGG

SEQ ID NO: 5081 - protein, 157 aa, Streptococcus pneumoniae
  misc_feature (B) LOCATION 1...157
  hypothetical: YES
PGKVCITKVKTGFGTGGWQLAALRWCAKAARKPIIADGGIRTHGDIAKSIRFGASMIMIGSLFAGHIESPGKTIEVDGEQFKEYYGSASQYQKGAYKNVEGKRILLPAKGHLQDTLTEMEQDLQSAISYAGGRQVADLKHVDYVIVKNSIWNGDASH

SEQ ID NO: 5082 - protein, 72 aa, Streptococcus pneumoniae
  misc_feature (B) LOCATION 1...72
  hypothetical: YES
ESKVWYCFTKAFLGSFKMRTKSSTVNCSRAAKTGKRPINSGIIPNFELLSYQGERWGRGTNVQGVQLRMGSA

SEQ ID NO: 5083 - protein, 331 aa, Streptococcus pneumoniae
  misc_feature (B) LOCATION 1...331
  hypothetical: YES
ARKVGGTMKTRITELLKIDYPIFQGGMAWVADGDLAGAVSKAGGLGIIGGGNAPKEVVKANIDKIKSLTDKPFGVNIMLLSPFVEDIVDLVIEEGVKVVTTGAGNPSKYMERFHEAGIIVIPVVPSVALAKRMEKIGADAVIAEGMEAGGHIGKLTTMTLVRQVATAISIPVIAAGGIADGEGAAAGFMLGAEAVQVGTRFVVAKESNAHPNYKEKILKARDIDTTISAQHFGHAVRAIKNQLTRDFELAEKDAFKQEDPDLEIFEQMGAGALAKAVVHGDVEGGSVMAGQIAGLVSKEETAEEILKDLYYGAAKKIQEEASRWTGVVRND

SEQ ID NO: 5084 - protein, 107 aa, Streptococcus pneumoniae
  misc_feature (B) LOCATION 1...107
  hypothetical: YES
RLEVAGFTWSLCLRIYLHGPLITTVSQDFTSLSDISATHFEQLHIVAIVHRNIQRNNSFLAGDNRLRFHRMTFLFYQNNWLVDFFRTIYFYLCCIHNHRILSTKMSF

SEQ ID NO: 5085 - protein, 106 aa, Streptococcus pneumoniae
  misc_feature (B) LOCATION 1...106
  hypothetical: YES
YREVNFMANLNRFKFTFGKKSLTLTSEHDNLFMEEIAKVATEKYQAIKEQMPSADDETIALLLAVNCLSTQLSREIEFDDKEQELEELRHKLVTCKQEQSKIEDSL

SEQ ID NO: 5086 - protein, 63 aa, Streptococcus pneumoniae
  misc_feature (B) LOCATION 1...63
  hypothetical: YES
RSEVQTIYKPMFWKTQDRHGKALVGNRVGQWRYRIGNYRVIVQIVDDELVVATLEVGHRRDIY

SEQ ID NO: 5087 - protein, 188 aa, Streptococcus pneumoniae
  misc_feature (B) LOCATION 1...188
  hypothetical: YES
TVEVFMNVWTKLAMFSFFETDRLYLRPFFFSDSQDFREIASNPENLQFIFPTQASLEESQYALANYFMKSPLGVWAICDQKNQQMIGSIKFEKLDEIKKEAELGYFLRKDAWSQGFMTEVVRKICQLSFEEFGLKQLSIITHLENEASQRVALKSGFSLFRQFKGSDRYTRKMRDYLEFRYVKGEFNE

SEQ ID NO: 5088 - protein, 228 aa, Streptococcus pneumoniae
  misc_feature (B) LOCATION 1...228
  hypothetical: YES
NKEVLFMEFMLDTLNLDEIKKWSEILPLAGVTSNPTIAKREGSINFFERIKDVRELIGSTPSIHVQVISQDFEGILKDAHEIRRQAGDDIFIKVPVTPAGLRAIKVLKKEGYHITATAIYTVIQGLLAIEVGADYLAPYYNRMENLNIDSNSVIRQLALAIDRQNSPSKILAASFKNVAQVNNALAAGAHAVTAGADVFESAFAMPSIQKAVDDFSDDWFVIQNSRSI

SEQ ID NO: 5089 - protein, 304 aa, Streptococcus pneumoniae
  misc_feature (B) LOCATION 1...304
  hypothetical: YES
LLEVRMKKLPLVFSGCLLGLAGAGNLILDTLPVLSHLFSLTGLVLWIYFLILHLFNWKETKQELTKPPLLSGMATFPMAGMILSTYVFRVFSYLPLVAQGIWWFSFLLDLTLIAGFTIKFACPGRMVHATPSWTVLYVGIAVAALTYPLVGIIEIAYATLSFGFLLTFYLYPLIYSDLKKHPLPLALLGQEGIYCAPFSLLLASLVRVGGTSLPTWGLIVMILASQSFFFFVLTRMPNILKQGFQPAFSALTFPTIITATSLKMAQGILKLPFLDYLVLAETIICLTILFFVLGAYLIWLRKKV

SEQ ID NO: 5090 - protein, 213 aa, Streptococcus pneumoniae
  misc_feature (B) LOCATION 1...213
  hypothetical: YES
LEEVKLMLNKIRDYLDFSGLQYRSPDKAGAEREKMLAFRHKGQEARKAFTELAKAFQASHPEWQLQQTSQWMNQAQRLRPHFWVYLQRDGQVTEPMMALRLYGTSTDFGISLEVSFIERKKDEQTLGKQAKVLDIPTVKGIYYLTYSNGQSQRWEANEEKRRTLREKVRSQEVRKVLVKVDVPMTENSSEEEIVEGLLKSYSKILPYYLATRK

SEQ ID NO: 5091 - protein, 186 aa, Streptococcus pneumoniae
  misc_feature (B) LOCATION 1...186
  hypothetical: YES
KLWVEASXRVLKGIDLGLGELRPDVIVMDIVMPEMNGIDATLAILKEWPEAKILIVTSYLDNEKIMPVLDAGAKGYMLKTSSADELLHAVSKVAAGELAIEQEVSKKVEYHRNHMELHEELTARERDVLQLIAKGYENQRIADDLFISLKTVKTHVSNILAKLEVSDRTQAAVYAFQHHLVGQEEF

SEQ ID NO: 5092 - protein, 64 aa, Streptococcus pneumoniae
  misc_feature (B) LOCATION 1...64
  hypothetical: YES
ASWVTIMTVFPSRFISKRNFKTKSLFSGSSEPVGSSAKISWLGFKMALATAIRCCSPPDNSETL

SEQ ID NO: 5093 - protein, 95 aa, Streptococcus pneumoniae
  misc_feature (B) LOCATION 1...95
  hypothetical: YES
GLGVKKQKACFSAIEEVIMYKHLFFLDSKTLDRLTPYILVLASDTIAFNVFVLTFVSAVVFNFLNSMLALMAIFIGAGYVVGFWLLILNENQRAN

SEQ ID NO: 5094 - protein, 134 aa, Streptococcus pneumoniae
  misc_feature (B) LOCATION 1...134
  hypothetical: YES
RFSLAHELYHLYYDEVKKSSVSLILIGEGDETERKADQFASYFLIFPSSLYRMVEEIRENANRTHLEVEDIIKLGQFYGISHKAMLYRLRNDGYLDAEEIKNMDISVIETASRLGYDTSLYRPLSESKKEMALG

SEQ ID NO: 5095 - protein, 222 aa, Streptococcus pneumoniae
  misc_feature (B) LOCATION 1...222
  hypothetical: YES
QPLLVQMVLENRLFLSIMSRLTKKDQGVLSIKGREIESWNSQELAQELTILKQKINYQAKLTVEELVSFGRFPYSRGRLRSEDWEKIRETLNYLELTNLKDRYINSLSGGQLQRVFIAMVLAQDTDFILLDEPLNNLDIKQSVSMMQILRRLVEELGKTIIIVLHDINMASQYADEIVAFKDGQVFSKGSTDQIMQADLLSQLYEIPITLADINDKKICIYS

SEQ ID NO: 5096 - protein, 617 aa, Streptococcus pneumoniae
  misc_feature (B) LOCATION 1...617
  hypothetical: YES
SDLFRKCVNMEFSKKTRELSIKKMQERTLDLLIIGGGITGAGVALQAAASGLETGLIEMQDFAEGTSSRSTKLVHGGLRYLKQFDVEVVSDTVSERAVVQQIAPHIPKPDPMLLPVYDEDGATFSPFRLKVAMDLYDLLAGVSNTPTANKVLSKKEVLERQPNLKKEGLVGGGVYLDFRNNDARLVIENIKRANQDGALIANHVKAEGFLFDESGKITGVVARDLLTDQVFEIKARLVINTTGPWSDKVRNLSNKGTQFSQMRPTKGVHLVVDSSKIKVSQPVYFDTGLGDGRMVFVLPRENKTYFGTTDTDYTGDLEHPKVTQEDVDYLLGIVNNRFPESNITIDDIESSWAGLRPLIAGNSASDYNGGNNGTISDESFDNLIATVESYLSKEKTREDVESAVSKLESSTSEKHLDPSAVSRGSSLDRDDNGLLTLAGGKITDYRKMAEGAMERVVDILKAEFDRSFKLINSKTYPVSGGELNPANVDSEIEAFAQLGVSRGLDSKEAHYLANLYGSNAPKVFALAHSLEQAPGLSLADTLSLHYAMRNELALSPVDFLLRRTNHMLFMRDSLDSIVEPVLDEMGRFYDWTEEEKATYRADVEAALANNDLAELKN

SEQ ID NO: 5097 - protein, 293 aa, Streptococcus pneumoniae
  misc_feature (B) LOCATION 1...293
  hypothetical: YES
EGLLSLMNTLAEKFRLKRKELRLSQQTLAEGICEQSQISKIERGHFIPSADLLFKLSQRLEVPLDYFFNEQIEIKSNLSNFKQLSARLLDDRNYDDLEYIYRIEIERSTFLTLEDRTYLEWIKAIIDFYQYDSKCEAISSLENILLKVSSNTLIYLKALNTLSNFYSLVGREQEYEANYSHLIELYQTKNLDHQEFLFGYIRVRYNYAHYLVSKEKYNEAIQEALETIELCKQRQTSYQLAPLLILVGNAGAKFLDREQVKNYYIEARELCKIYNNPLMLMKIENYLKELDTV

SEQ ID NO: 5098 - protein, 64 aa, Streptococcus pneumoniae
  misc_feature (B) LOCATION 1...64
  hypothetical: YES
PILLEGVSGETRWHWHFPRTKRNPGGVQTILGVSKKFLVNLFIGLNTLLFLIQIFYHQMKSKIK

SEQ ID NO: 5099 - protein, 503 aa, Streptococcus pneumoniae
  misc_feature (B) LOCATION 1...503
  hypothetical: YES
PQLFTPNLKTIQNPCLSLDPGWFLFSPNGCFLLDKKEFPLYGISVEKNTKRKETHMNSLPNHHFQNKSFYQLSFDGGHLTQYGGLIFFQELFSQLKLKERISKYLVTNDQRRYCRYSDSDILVQFLFQLLTGYGTDYACKELSADAYFPKLLEGGQLASQPTLSRFLSRTDEETVHSLRCLNLELVEFFLQFHQLNQLIVDIDSTHFTTYGKQEGVAYNAHYRAHGYHPLYAFEGKTGYCFNAQLRPGNRYCSEEADSFITPVLERFNQLLFRMDSGFATPKLYDLIEKTGQYYLIKLKKNTVLSRLGDLSLPCPQDEDLTILPHSAYSETLYQAGSWSHKRRVCQFSERKEGNLFYDVISLVTNMTSGTSQDQFQLYRGRGQAENFIKEMKEGFFGDKTDSSTLIKNEVRMMMSCIAYNLYLFFKHLAGGDFQTLTIKRFRHLFLHVVGKCVRTGRKQLLKLSSLYAYSELFSALYSRIRKVNLNLPVPYEPPRRKASLMMH

SEQ ID NO: 5100 - protein, 287 aa, Streptococcus pneumoniae
  misc_feature (B) LOCATION 1...287
  hypothetical: YES
KKLFSCALAFSTIGTLSTIDKSGVLPFSAQTVQADIQTLTPMAKYYIILPKDAEIYKTWRGTVNIPIIDATKTTPELSYFKEDHRNYIANENKSGANYIEWKGTVEEFKEAIKKLTDKKSTTATPKKDEKPTPKPDEKPKPTPTVQSGWVGSSYYQDGKKVISKWIFDKKYNSYFYLDASGNYVQNAWVGNYYLKSGGYMAKGEWVYDATYQAWYYLTSDGSYAYSTWQGNYYLKSDGKMAVNEWVDGGRYYVGADGVWKEGQASTVSSSNDSNSEYFCCFRKGKKL

SEQ ID NO: 5101 - protein, 100 aa, Streptococcus pneumoniae
  misc_feature (B) LOCATION 1...100
  hypothetical: YES
LELFGGIINMANKQDLIAKVAEATELTKKDSAAAVEAVFAAVADYLAAGEKVQLIGFSNFEVRERAERKGRNPQTGKEMTIAASKVPAFKAGKALKDAVK

SEQ ID NO: 5102 - protein, 95 aa, Streptococcus pneumoniae
  misc_feature (B) LOCATION 1...95
  hypothetical: YES
CPFLFQYTMAPMTYKDTMTSDFFEACFQKFLLPTLDTPSLIIMDNARFHRMNMCKEQGIDCYHFLPIHLSIIPLRKYGLTSKTSQNNIVKLRCFS

SEQ ID NO: 5103 - protein, 293 aa, Streptococcus pneumoniae
  misc_feature (B) LOCATION 1...293
  hypothetical: YES
KRLLHMSRQTPSLSFEVFPPNPAVGNGNIISALQDMQELAPHFISVTASNNKFNIKETTVRLADFIQNDLAIPTIAHLPAIYLTKDKVAETIADLDKVGVQKILALRGDIIPDVEPQKDFRYATDLIEFIKEQTPHFDIIGACYPEGHPDSPNQISDIQNLKKKVDAGCSSLVTQLFFDNERFYDFQDKCILAGIDVPIHAGIMPILNRNQALRLLKTCENIHLPRKFKAILDKYEHDPESLRAAGLAYAVDQIVDLVTQDVAGVHLYTMNNADTAKYIHQATHALFNHQSLG

SEQ ID NO: 5104 - protein, 194 aa, Streptococcus pneumoniae
  misc_feature (B) LOCATION 1...194
  hypothetical: YES
LEFLNKGGQMKKVMFAGLSLLSLVVLMACGEEETKKTQAAQQPKQQTTVQQIAVGKDAPDFTLQSMDGKEVKLSDFKGKKVYLKFWASWCGPCKKSMPELMELAAKPDRDFEILTVIAPGIQGEKTVEQFPQWFQEQGYKDIPVLYDTKATTFQAYQIRSIPTEYLIDSQGKIGKIQFGAISNADAEAAFKEMN

SEQ ID NO: 5105 - protein, 452 aa, Streptococcus pneumoniae
  misc_feature (B) LOCATION 1...452
  hypothetical: YES
GGLFMDQQNGLFGFLENHVMGPMGKLAQFKVVRAITAAGMAAVPFTIVGSMFLVFSILPQAFSFWPIVADIFSASFDKFRSLYMVANYATMGSLSLYFVLSLAYELTKIYAEEEELNMNPLNGALLALMAFVMTVPQIIFDGGMMKTVTSLKEGAVIADGWAMGNGVARFGTTGIFTAIIMAIVTVLIYRMCVKHNWVIKMPEAVPEGVSRGFTALVPGFVVAFVVIFINGLLVAMGTDIFKVIAIPFGFVSNLTNSWIGLMIIYLLTQLLWIVGIHGANIVFAFVSPIALANMAENAAGGHFAVAGEFSNMFVIAGGSGATLGLCLYIAFASKSEQLKAIGRASVVPALFNINEPLIFGLPIIYNPALAIPFILAPMVTATIYYVANSLNFIKPIIAQVPWPTPVGIGAFLGTADLRAVLVALVCAFAAFLVYLPFIRVYDQKLVKEEQGI

SEQ ID NO: 5106 - protein, 120 aa, Streptococcus pneumoniae
  misc_feature (B) LOCATION 1...120
  hypothetical: YES
IRLFFGIIKVMEIEKTNRMNALFEFYAALLTDKQMNYIELYYADDYSLAEIAEEFGVSRQAVYDNIKRTEKILEDYEMKLHMYSDYIVRSQIFDQILERYPKDDFLQEQIEILTSIDNRE

SEQ ID NO: 5107 - protein, 169 aa, Streptococcus pneumoniae
  misc_feature (B) LOCATION 1...169
  hypothetical: YES
RRLFAHWDLSTWKLLTSTKKFTTGLDFLNSQRDDILSAKNLLLETITEMNDEVKERFKSTFEAIRESFKVTFKQMFGGGQADLILTEGDLLTAGVEISVHLRDKKIQSLNLMSGGEKALRLLPCFSPLFVSRPFLLSSWMRWKLRWMKPMLNVLGITSTALTRTASLSS

SEQ ID NO: 5108 - protein, 75 aa, Streptococcus pneumoniae
  misc_feature (B) LOCATION 1...75
  hypothetical: YES
MVIFLLKMKHFFAGIGEINFVSYLLYICVGIAPFFHVYIIGSEMNFVKIVLSILGIIFVCILTIARIYRTFFYKE

SEQ ID NO: 5109 - protein, 235 aa, Streptococcus pneumoniae
  misc_feature (B) LOCATION 1...235
  hypothetical: YES
YYILKGGDNMVEQRKSITMKDVALEAGVSVGTVSRVINKEKGIKEVTLKKVEQAIKTLNYIPDYYARGMKKNRTETIAIIVPSIWHPFFSEFAMHVENEVYKRNNKLLLCSINGTNREQDYLEMLRHNKVDGVVAITYSPIEHYLTSGIPFVSIDRTYSDIAIPCVSSDNDAGWREAAKQLISKGCQHLAFVGGHNTTINETKRRRIHLKSMSKSIKYFLVFLIWMRQLLTIMES

SEQ ID NO: 5110 - protein, 69 aa, Streptococcus pneumoniae
  misc_feature (B) LOCATION 1...69
  hypothetical: YES
PVSLEPLSVILNTVEKSEKVWRQIALNALTGSLSDGFFGMDVAKLKKKITKNFAKNIHIKSLFFEIRES

SEQ ID NO: 5111 - protein, 151 aa, Streptococcus pneumoniae
  misc_feature (B) LOCATION 1...151
  hypothetical: YES
KEIFITEKKGKSSQVPTGSSIPKRYLLDGKTPRISATNIDNGILGYYEDIDDKNYRVFENFISVSCLGAVFYHKYKASLDMKIHCLKLKNKELNKEVAFYLTSIIRQALKNTEYKDQISSTVLPDIKIKLPIDSRGTPDWNYMERYRERER

SEQ ID NO: 5112 - protein, 110 aa, Streptococcus pneumoniae
  misc_feature (B) LOCATION 1...110
  hypothetical: YES
NRIFDNNCLIQVYKFISFYDICEMVFAFHLPPDELITNVIFKEKINSMLKCYIDRLLYVFINPTHFTEKVNLQFYGSFFSYEFICREVGNILKNKGVKCNLNFFEGEEYL

SEQ ID NO: 5113 - protein, 233 aa, Streptococcus pneumoniae
  misc_feature (B) LOCATION 1...233
  hypothetical: YES
KQILVLVKKGKSMSDRTIGILGLGIFGSSVLAALAKQDMNIIAIDDHAERINQFEPVLARGVIGDITDEELLRSAGIDTCDTVVVATGENLESSVLAVMHCKSLGVPTVIAKVKSQTAKKVLEKIGADSVISPEYEMGQSLAQTILFHNSVDVFQLDKNVSIVEMKIPQSWAGQSLSKLDLRGKYNLNILGFREQENSPLDVEFGPDDLLKADTYILAVINNQYLDTLVALNS

SEQ ID NO: 5114 - protein, 81 aa, Streptococcus pneumoniae
  misc_feature (B) LOCATION 1...81
  hypothetical: YES
IKILDKRKRMTPNKEDYLKCIYEIGIDLHKITNKEIAARMQVSPPAVTEMIKRMKSENLILKDKECGFLRTDLGLKLVSEL

SEQ ID NO: 5115 - protein, 150 aa, Streptococcus pneumoniae
  misc_feature (B) LOCATION 1...150
  hypothetical: YES
PFVFATENDSLNGVSMLFNHLLTNTPQIFADVRTYWSPEAVERVTGYTLEGRAAAGFLHLINSGSCTLDGTGQATRDGKPVMKPFWELDESEVQAMLENTDVPTSKPRILPWRRILNSFLDEGGYASNNGTSQSFKRGWSSATNCRRLHT

SEQ ID NO: 5116 - protein, 295 aa, Streptococcus pneumoniae
  misc_feature (B) LOCATION 1...295
  hypothetical: YES
THVFVIRKEVNVMKPMPLWKRNLKKFYNNKLAFIGFICFMLILLACILAPLLTTYSPDVVDLGSMNRPPSAKHILGTDKLGRDVFARILYGGRVSIQVGMYGAICGAVIGTVLGGIAGYFGGKIDALLVRLAELFLTFPNMIVILLLSSIFGQGVFNLIFVFSVMGWMTTFRMVRNEFMSLKQETYVDVCRAFGFSDSRIIFNNILRNAISPVIVSLSLNVAGFILSEAGLSFLGVGVPSDIPTWGNIINAAKTADVIKNSWWLWLVPGSIITLFVLSINFIGDGLRDIMDPKQQ

SEQ ID NO: 5117 - protein, 75 aa, Streptococcus pneumoniae
  misc_feature (B) LOCATION 1...75
  hypothetical: YES
VTVFAYSEPNGLPMAIAVSPTVNLLESPNSATVVTFSEEILTTAISEKVSAPTISPGTLVPSDNRISTLLAPFIT

SEQ ID NO: 5118 - protein, 188 aa, Streptococcus pneumoniae
  misc_feature (B) LOCATION 1...188
  hypothetical: YES
NKVLSNREKRISMRKEIAPELYNYNKFPGPEFHLHGDKVETEGIAFSLVENIKDAFDVTTFNQRFSEVLTKFDYIVGDWSNEQLRLRGFYKDDRTEEKLEKISRLQDYLLEYCSYGCAYFVLENEAPKRASFDKKMRKTEEETPSRKGKKPTQTKRKSNADKKNRRRQKDQHSQKEDKGQRHFVIRQK

SEQ ID NO: 5119 - protein, 89 aa, Streptococcus pneumoniae
  misc_feature (B) LOCATION 1...89
  hypothetical: YES
KRVFVMDTKIMEQFHEMDITMLSSIEGGKNNWQTNVLEGGGAAFGGWGLGTAICAASGVGAPFMGACGYIGAKFGVALWAGVTGATSGF

SEQ ID NO: 5120 - protein, 344 aa, Streptococcus pneumoniae
  misc_feature (B) LOCATION 1...344
  hypothetical: YES
VMVFTAKSSKINIEEVRALSKLEGQALERKSQRDQELEAIIRGEDQRILLVIGPCSSDNEEAVLEYAKRLAVLQEEVADRIFMVMRVYTAKPRTNGDGYKGLIHQPNATEAPSLINGIKAVRHLHYRVITETGMTTADEMLYPENLPLVDDLISYMAVGARSVEDQQHRFVASGAGFSTGFKNPTSGNLNVMFNGIYAAQNKQSFLFLGKEVETTGNPLSHAILRGALNEYGKNIPNYYYDNLIDTIAQYEKMGLENPFIIIDTNHDNSGKQYIEQIRIVRQTLINRAWNEKIKQFVRGFMIESYLEDGRQNEPEVFGKSITDPCLGWDNTEALVREIYKTLGE

SEQ ID NO: 5121 - protein, 298 aa, Streptococcus pneumoniae
  misc_feature (B) LOCATION 1...298
  hypothetical: YES
KEVFMTYYVAIDIGGTNIKYGLVDQEGQLLESHEMPTEAHKGGPHILQKTKDIVASYLEKGPVAGVAISSAGMVDPDKGEIFYAGPQIPNYAGTQFKKEIEESFTIPCEIENDVNCAGLAEAVSGSGKGASVTLCLTIGTGIGGCLIMDRKVFHGFSNSACEVGYMHMQDGAFQDLASTTALVKYVAEAHGEDVDQWNGRRIFKEATEGNKICMEGIDRMVDYLGKGLANICYVANPEVVILGGGIMGQEAILKPKIRTALKEALVPSLAEKTRLEFAHHQNTAGMLGAYYHFKTKQS

SEQ ID NO: 5122 - protein, 512 aa, Streptococcus pneumoniae
  misc_feature (B) LOCATION 1...512
  hypothetical: YES
RRFLMKSKIVLGASLAIATLSLVSLVEIEGLSPFLIENVSANTHSANKVINHKVSIYLENADEGKGLTVNFSTDSVSPNLFDEFEKKSGITITTMLVNAKTGEVVEKRLTPSVFLRSNDLTSGTISSFIFSEYPDGEYKYVVSKGDFIDPKTQFKHQYRGESPVFRIRNRKYVELGTTDKKLDERRDNSVYKDGVVEHKVNLSLTSYQGGNGVTAIFSTDSVNSNLLNSFGEKAKKVLIRSKLINVKTGEVIDETFSPKVSLTSKILKSGSTAVFYFIDLTDGEYKYVAYESQQYTDPQTTLTHQYRGESPIFSIKDGKFSGLVSASKPDENPKPTPKPDEKPKPSAPQQEKPKPTVQSGWVGSSYYQNGKKVTSKWIFDKKYNSYFYLDASGNYVQNAWVGNYYLKSGGYMAKSEWIYDKNYGSYYYLTSEGSYARNTWSGNYYLKSNGKMAKSEWVYDSNYKSYYYLTSEGSYARNTWVGNYYLKSNGKMAVNERTPDGYRVDGSGKWVK

SEQ ID NO: 5123 - protein, 258 aa, Streptococcus pneumoniae
  misc_feature (B) LOCATION 1...258
  hypothetical: YES
IQSLKRRRREITKMKRWIALSKIDFLLTKRQLIYYLLSVGMPTAFYLFFSGIYQDTPGELANFMRDYLISMTAFSMMSTAIFSFPVVLHTDKINNWQKTLRHSPVNMVEYYLSKITSMLVDYLVSILVVFSVGHFVRGVDMSLGNWIGAALLLIVGSIAFVALGLTLTLLPTSQLMSVVGNLLYLGLAVLGGLWMPISLFPDWMQVVGKCLPTYQLMELLKTFLNEGGINLSATVYLLVFSVVLFGLTIYLQGHKENA

SEQ ID NO: 5124 - protein, 79 aa, Streptococcus pneumoniae
  misc_feature (B) LOCATION 1...79
  hypothetical: YES
VHSFRGIREILFQLWSEKEGRAEKLGTGLIFSDILLRHNAKQSLIDSDKMVPIQSFLRSSVDSHWQYLSIIQPKIEYET

SEQ ID NO: 5125 - protein, 159 aa, Streptococcus pneumoniae
  misc_feature (B) LOCATION 1...159
  hypothetical: YES
TNSLRMPLKRPLKNRKKEKNMSKEKVILAYSGGLDTSVAITWLKKDYDVVAVCMDVGEGKDLDFIHDKALKVGAVESYVIDVKDEFATDYVLVAHQSHAYYEQKYPLVSALSRPLISKKLVEIAHQIGATTIAHGCTGKGNDQVEYQIAVAKKANEAKK

SEQ ID NO: 5126 - protein, 201 aa, Streptococcus pneumoniae
  misc_feature (B) LOCATION 1...201
  hypothetical: YES
KTSFSCELAFFLCPHFRSNHWKILTVSDTMEEKRLEYPMVTFLGNPVSFTGKQLQVGDKALDFSLTTTDLSKKSLADFDGKKKVLSVVPSIDTGICSTQTRRFNEELAGLDNTVVLTVSMDLPFAQKRWCGAEGLDNAIMLSDYFDHSFGRDYALLINEWHLLARAVFVLDTDNTIHYVEYVDNINSEPNFEAAIAAAKAL

SEQ ID NO: 5127 - protein, 233 aa, Streptococcus pneumoniae
  misc_feature (B) LOCATION 1...233
  hypothetical: YES
GLSLFHSIGENRMKKIISHRYFIIVFLLVIADQKFSVLVLRSDLVAGLSDFAYYLSDMMLNFLVVLFALIAMIWSGKWQKINSRKFKGSYLFYSFLALLAFVAWNFVTFFLFPPTRNEISYQHAAPTFTGATAFLMYFFYPVIAGPIFEDMIYRGLVMTALEKGKKWGLDVLGSAVLFGVSHISNHGWVLTDFVFYMGGGLIFAVLFRMTKSIYWPIGLHIVYNGIGQLLMLL

SEQ ID NO: 5128 - protein, 163 aa, Streptococcus pneumoniae
  misc_feature (B) LOCATION 1...163
  hypothetical: YES
LTPLLSAYHLIKRPVIDKCQISKISTSSVSVFFIASITTLTINMMSKKYSVQAEPQVIVASGAQPTSVILNCIPVFSTNFASDAEKAPFSIPMIAPIPVRAMASLIPPSSALENFTPKSKANTVKMINMMTGPPISKMGLKTFPIRSKIASITVPPFFMLYEC

SEQ ID NO: 5129 - protein, 120 aa, Streptococcus pneumoniae
  misc_feature (B) LOCATION 1...120
  hypothetical: YES
FEPFYPLSYAKSETEIPRRAAISSARFNCFKPSTVARTMLIGVLEPSDLDVISATPANSTTARTAPPAATPEPSTAGFNNTLAPPNSERTSCGIVVPTIGTSIKFFLASSTALRIASGTS

SEQ ID NO: 5130 - protein, 155 aa, Streptococcus pneumoniae
  misc_feature (B) LOCATION 1...155
  hypothetical: YES
FETFACNLRRNINMDGITKDFIKTAKLMKQLWPQLTDKEAIDEVKKYTNGKNTAIFTEVEGDTIVGLALCSLRFDYVEGCKYSPVGFLEGIIVDEEYRLKDIAKNLCTKCEEWAKNKGCKEFASDCTLTNTDSIRFHLNIGFQEANRIIHFKKKL

SEQ ID NO: 5131 - protein, 86 aa, Streptococcus pneumoniae
  misc_feature (B) LOCATION 1...86
  hypothetical: YES
LLTLPLAQVVILRDVSSKSMAQSHLVRQRLPFMQLHKRKKKVGLLPLSMRNMPLIQLMLRPLVSILTNCSCLNQTQESKVLRLREN

SEQ ID NO: 5132 - protein, 420 aa, Streptococcus pneumoniae
  misc_feature (B) LOCATION 1...420
  hypothetical: YES
IMTFSFDTAAAQGAVIKVIGVGGGGGNAINRMVDEGVTGVEFIAANTDVQALSSTKAETVIQLGPKLTRGLGAGGQPEVGRKAAEESEETLTEAISGADMVFITAGMGGGSGTGAAPVIARIAKDLGALTVGVVTRPFGFEGSKRGQFAVEGINQLREHVDTLLIISNNNLLEIVDKKTPLLEALSEADNVLRQGVQGITDLITNPGLINLDFADVKTVMANKGNALMGIGIGSGEERVVEAARKAIYSPLLETTIDGAEDVIVNVTGGLDLTLIEAEEASQIVNQAAGQGVNIWLGTSIDESMRDEIRVTVVATGVRQDRVEKVVAPQARSATNYRETVKPAHSHGFDRHFDMAETAELPKQNPRRLEPTQASAFGDWDLRRESIVRTTDSVVSPVERFEAPISQDEDELDTPPFFKNR

SEQ ID NO: 5133 - protein, 165 aa, Streptococcus pneumoniae
  misc_feature (B) LOCATION 1...165
  hypothetical: YES
KMAFKDNAVELEERVVAVNRVTKVVKGGRRLRFAALVVVGDHNGRVGFGTGKAQEVPEAIRKAVDDAKKNLIEVPMVGTTIPHEVLSEFGGAKVLLKPAVEGSGVAAGGAVRAVVELAGVADITSKSLGSNTPINIVRATVEGLKQLKRAEEIAALRGISVSDLA

SEQ ID NO: 5134 - protein, 66 aa, Streptococcus pneumoniae
  misc_feature (B) LOCATION 1...66
  hypothetical: YES
RKAFNITLQKANTKLEKPINQPLSSHIFRHTLLSTLAEKNAIMVRVEHKNAKTVNNIYTHVSKRME

SEQ ID NO: 5135 - protein, 410 aa, Streptococcus pneumoniae
  misc_feature (B) LOCATION 1...410
  hypothetical: YES
KAPFGFDTIVSKFERSFNMNRYAVQLISRGAINKMGNMLYDYGNSVWLASMGTIGQTVLGMYQISELVTSILVNPFGGVISDRFSRRKILMTADLVCGILCLAISFIRNDSWMIGALIVANIVQAIAFAFSRTANKAIITEVVEKDEIVIYNSRLELVLQVVGVSSPVLSFLVLQFASLHMTLLLDSLTFFIAFVLVAFLPKEEAEVQEKKAFTGRDIFVDIKDGLHYIWHQQEIFFLLLVASSVNFFFAAFEFLLPFSNQLYGSEGAYASILTMGAIGSIIGALLASKIKANIYNLLILLALTGVGVFMMGLPLPTFLSFSGNLVCELFMTIFNIHFFTQVQTKVESEFLGRVLSTIFTLAILFMPIAKGFMTVLPSVHLSSFLIIGSGVIILSCISFIYVRTHFEKLI

SEQ ID NO: 5136 - protein, 75 aa, Streptococcus pneumoniae
  misc_feature (B) LOCATION 1...75
  hypothetical: YES
IYPLGFSVPIIRVKTAIPTPEKTKPAMAGRKCSPDRAPREGGKIKFPAPKNIPNRSKPVRVPFLAIKISFIFIKY

SEQ ID NO: 5137 - protein, 81 aa, Streptococcus pneumoniae
  misc_feature (B) LOCATION 1...81
  hypothetical: YES
CLQLIKICFFRVVISECNIFPICRTFIHTKRSIIWTTLYSGLTIFSKKIMFEAIKYIPKISTLDYIFVLDPSAKSNFLVQP

SEQ ID NO: 5138 - protein, 76 aa, Streptococcus pneumoniae
  misc_feature (B) LOCATION 1...76
  hypothetical: YES
MVQLLFTLSSHMLFIYVSFYLLKDLVRWEKVLKVTDENTRKVRLLVAFFSIVIGYILSSFFISLYHLWQEALRGLL

SEQ ID NO: 5139 - protein, 116 aa, Streptococcus pneumoniae
  misc_feature (B) LOCATION 1...116
  hypothetical: YES
MAQLTINGVAVKPPKSFQVGIQDIDGETGRNANGDMVRDRITTKRKLDCEWGMMTQGEISQLLHAVSSKFFEVSYPDPMDGQVTKTFYVGDRTAPSYTFTEKLKPWSGAKFNLVER

SEQ ID NO: 5140 - protein, 67 aa, Streptococcus pneumoniae
  misc_feature (B) LOCATION 1...67
  hypothetical: YES
KKQLMRSGRDKKIAGVCAGVAHYLDMDPTIVQVIWGVLTCCYGSGIVAYIILWIIAPVATVFTTGFH

SEQ ID NO: 5141 - protein, 582 aa, Streptococcus pneumoniae
  misc_feature (B) LOCATION 1...582
  hypothetical: YES
LLQFVVKTTARIRNNLSRWVGRRRDLGGLIFIDLRDREGIMQLVINPEKVSAEVMATAESLRSEFVIEVTGQVAAREQANDKLPTGAVELNVTALIVLNTAKTTPFEIKDGIEANDDTRLRYRYLDLRRPEMLENLKLRAKVTHSIRNYLDELEFIDVETPFLSKSTPEGARDYLVPSRVNKGHFYALPQSPQITKQLLMNAGFDRYYQIVKCFRDEDLRGDRQPEFTQVDLETSFLTEQEIQDITEGLIARVMKETKGIEVTLPFPRMKYDDAMALYGSDKPDTRFDMLLQDLTEVVKGVDFKVFSEAPAVKAIVVKEAADNYSRKDIDKMTEVAKQYGAKGLAWVKVVDGELNGPVAKFLTGIQEELTTALALEDKDLVLFVADTLEVANATLGALRGRIAKELGLIDNDKFNFLWVVDWPMFEWSEEEGRYMSAHHPFTLPQEETVHELEGDLAKVRAIAYDIVLNGYELGGGSLRINQKDLQERMFKALGFSTEEANDQFGFLLEAMDYGFPPHGGLAIGLDRFVMLLAGEENIREVIAFPKNNKATDPMTQAPSTVALKQLEELSLQVEEDETNKTN

SEQ ID NO: 5142 - protein, 437 aa, Streptococcus pneumoniae
  misc_feature (B) LOCATION 1...437
  hypothetical: YES
PMFFKLLREALKVKQVRSKILFTIFIVLVFRIGTSITVPGVNANSLNALSGLSFLNMLSLVSGNALKNFSIFALGVSPYITASIVVQLLQMDILPKFVEWGKQGEVGRRKLNQATRYIALVLAFVQSIGITAGFNTLAGAQLIKTALTPQVFLTIGIILTAGSMIVTWLGEQITDKGYGNGVSMIIFAGIVSSIPEMIQGIYVDYFVNVPSSRITSSIIFVIILIITVLLIIYFTTYVQQAEYKIPIQYTKVAQGAPSSSYLPLKVNPAGVIPVIFASSITAAPAAILQFLSATGHDWAWVRVAQEMLATTSPTGIAMYALLIILFTFFYTFVQINPEKAAESLQKSGAYIHGVRPGKGTEEYMSKLLRRLATVGSLFLGVISILPIAAKDVFGLSDVVAFGGTSLLIIISTGIEGIKQLEGYLLKRKYVGFMDRTE

SEQ ID NO: 5143 - protein, 778 aa, Streptococcus pneumoniae
  misc_feature (B) LOCATION 1...778
  hypothetical: YES
QFPFCFFFDIITLTVILYGGSMRFNQYSYINFPKENVLSELKKCGFDLQNTANHKDSLETFLRRFFFTYQDTNYPLSILAADKKTDLLTFFQSEDELTADIFYTVAFQLLGFSYLVDFEDSDVFRKETGFPIIYGDLIENLYQLLNTRTKKGNTLIDQLVSDGLIPEDNDYHYFNGKSLATFSNQDVIREVVYVESRVDTDQKGLSDLVKVSIIRPRFDGKIPAIMTASPYHQGTNDKASDKALYKMEGELEVKLPHKIELEKPQLNLVQPQGKAELIAEAEEKLTHINSSYTLNDYFLPRGFANLYVSGVGTKDSTGFMTNGDYQQIEAYKNVIDWLNGRCRAFTDHTRQRQVKADWSNGKVATTGLSYLGTMSNGLATTGVDGLEVIIAEAGISSWYNYYRENGLVTSPGGYPGEDFDSLAELTYSRNLLAGDYIRGNEAHQADLEKVKAQLDRKTGDYNQFWHDRNYLLNAHKVKAEVVFTHGSQDWNVKPLHVYQMFHALPTHIHKHLFFHNGAHVYMNNWQSIDFRESINALLTKKLLGQETDFQLPTVIWQDNTAPQTWLSLDNFGGQENCETFSLGQEEQAIQNQYPDKDFERYGKTYQTFNTELYQGKANQITINLPVTKDLHLNGRAQLNLRIKSSTNKGLLSAQLLEFGPKKYLQPYPAILSARTIDNGRYHMLENLCELPFRPEAQRVVTKGYLNLQNRNDLLLVEDITADEWMDVQFELQPTIYKLKEGDTLRLVLYTTDFEITIRDNTDYHLTVDLAQSMLTLPC

SEQ ID NO: 5144 - protein, 246 aa, Streptococcus pneumoniae
  misc_feature (B) LOCATION 1...246
  hypothetical: YES
DPKFQILDIINKDTQQGIFGKLDYEAPSCPECGSQMKKYYFQKPSKIPYLETTGMPTRILLRKRRFKCYHCSKIMVAETSIVKKNHQIPRIINQKIAQKLIEKISMTDIAHQLSISTSTVIRKLNDFHFKHDFSCLSEIMSWDEYAFTKGKMSFIAQDFNKLNIITVLEGRTQAIIRNHFLRYDRVVRCRVKIITMDMFSPYYDLAKQLRFQISRLRLKQSPRLFHSRMLKSCWIAFTLYNILAVL

SEQ ID NO: 5145 - protein, 203 aa, Streptococcus pneumoniae
  misc_feature (B) LOCATION 1...203
  hypothetical: YES
YTKLLEANPQYVVLNPLEAKAKWRDLFGNDNPIHVEVGSGKGAFVSGMAKQNPDINYIGIDIQKSVLSYALDKVLEVGVPNIKLLWVDGSDLTDYFEDGEIDRLYLNFSDPWPKKRHEKRRLTYKTFLDTFKRILPENGEIHFKTDNRGLFEYSLVSFSQYGMKLNGVWLDLHASDFEGNVMTEYEQKFSNKGQVIYRVEAEF

SEQ ID NO: 5146 - protein, 111 aa, Streptococcus pneumoniae
  misc_feature (B) LOCATION 1...111
  hypothetical: YES
YNKFEVIFKENQMIYEFCAENVTLLEKAMQAGARRIELCDNLAVGGTTPSYGVTKAAVELAANYDTTIMTMIRPRGGDFVYNDLEIAIMLEDICLTAQAWKSRGCIWSFNC

SEQ ID NO: 5147 - protein, 189 aa, Streptococcus pneumoniae
  misc_feature (B) LOCATION 1...189
  hypothetical: YES
MTKLLVGLGNPGDKYFETKHNVGFMLIDQLAKKQNVTFTHDKIFQADLASFFLNGEKIYLVKPTTFMNESGKAVHALLTYYGLDIDDLLIIYDDLDMEVGKIRLRAKGSAGGHNGIKSIIQHIGTQVFNRVKIGIGRPKNGMSVVHHVLSKFDRDEYIGILQSVDKVDDSVNYYLQEKNFEKTMQRYNG

SEQ ID NO: 5148 - protein, 132 aa, Streptococcus pneumoniae
  misc_feature (B) LOCATION 1...132
  hypothetical: YES
IFFSLSPTPTPIPXSSFLSPSQPPPXPXFSFPLFPXTSXNTLFFLLFPPPXXTPPSSSFPSLPXFSPPFXFPSFFXFPFXXXXXFFFXXXXXXYXXXPXXXXXXXXXXXXXYSMKIKEQTRKLAAGCSKHCF

SEQ ID NO: 5149 - protein, 657 aa, Streptococcus pneumoniae
  misc_feature (B) LOCATION 1...657
  hypothetical: YES
MKKFYVSPIFPILVGLIAFGVLSTFIIFVNNNLLTVLILFLFVGGYVFLFKKLRVHYTRSDVEQIQYVNHQAEESLTSLLEQMPVGVMKLNLSSGEVEWFNPYAELILTKEDGDFDLEAVQTIIKASVGNPSTYAKLGEKRYAVHMDASSGVLYFVDVSREQAITDELVTSRPVIGIVSVDNYDDLEDATSESDISQINSFVANFISEFSEKYMMFSRRVSMDRFYLFTDYTVLEGLMNDKFSVIDAFREESKQRQLPLTLSMGFSYGDGNHDEIGKVALLNLNLAEVRGGDQVVVKENDETKNPVYFGGGSAASIKRTRTRTRAMMTAISDKIRSVDQVFVVGHKNLDMDALGSAVGMQLFASNVIENSYALYDEEQMSPDIERAVSFIEKEGVTKLLSVKDAMGMVTNRSLLILVDHSKTALTLSKEFYDLFTQTIVIDHHRRDQDFPDNAVITYIESGASSASELVTELIQFQNSKKNRLSRMQASVLMAGMMLDTKNFTSRVTSRTFDVASYLRTRGSDSIAIQEIAATDFEEYREVNELILQGRKLGSDVLIAEAKDTKCYDTVVISKAADAMLAMSGIEASFVLAKNIQGFISISARSRSKLNVQRIMEELGGGGHFNLAAAQIKDVTLSEAGEKLTEIVLNEIKEKEKEE

SEQ ID NO: 5150 - protein, 443 aa, Streptococcus pneumoniae
  misc_feature (B) LOCATION 1...443
  hypothetical: YES
ACFSCLIINPKDLFPILWLSHFLLLQLYLFISWLTYLLIQKMTISSLLKGFSSFKFGLIFNYVMKIGTTILLTALLIGVGRSLEQENKELAYQQQWVSQGNYLTLETFKLNDNLWQEELAGSGKSTDYFYRFYQDLVEKTQAGYVQSSSLPVKNFVQSEQIQQYQLTDTVDVYYANRNFLKSKGFKLPDTGIKKVILMPASTKGEEDKNQLLGKLIAFHSMKYEEQQKRTIEEMDVEIAYYEGDWSFFPYSDKRKENLSNPIISLVNDSDMMWDEKASLSTTGLNNPIKIENTVQHQKEITELVEKLSDGNYLKFSSIQAIQQEKVDSYRDAVRNFNLLFALFGLLSMMISYFLLVTTFLLKRRDIITKKFMGWKLVDRYRPLLVLLLLGYSFPLLVLIFFAHAFLPLLLFAGFTCLDILFVLGLASRMEKRSLVELLKGGIL

SEQ ID NO: 5151 - protein, 128 aa, Streptococcus pneumoniae
  misc_feature (B) LOCATION 1...128
  hypothetical: YES
LSFSITDIKDIYWFIRKVSDKLASTLHLNGDSMKKFSLLLAILPFLVACENQATPKETSAQKTIVLATAGDSAPFDYEDKGNLTGFDIEVLKAVDEKLSDYEIQFQRTAWESIFPGLDSGHYQAAAIT

SEQ ID NO: 5152 - protein, 182 aa, Streptococcus pneumoniae
  misc_feature (B) LOCATION 1...182
  hypothetical: YES
GDFSFWRFVMKTKEVVDELTVKRAITRITYEIIERNKDLNKIVLAGIKTRGVFIAHRIQERLKQLENLSVPVVELDTKPFRDDVKSGEDTSLVSVDVTDREVILVDDVLYTGRTIRAAIDNIVGHGRPARVSLAVLVDRGHRELPIRPDYVGKNIPTSRSEEIIVEMTELDDQDRVLITEEA

SEQ ID NO: 5153 - protein, 404 aa, Streptococcus pneumoniae
  misc_feature (B) LOCATION 1...404
  hypothetical: YES
RLFSTDFTDSIITIIFLILKINKGESMIHFSINKNLFLQALNTTKRAISSKNAIPILSTVKIDVTNEGITLIGSNGQISIENFISQKNEDAGLLITSLGSILLEASFFINVVSSLPDVTLDFKEIEQNQIVLTSGKSEITLKGKDSEQYPRIQEISASTPLILETKLLKKIINETAFAASTQESRPILTGVHFVLSQHKELKTVATDSHRLSQKKLTLEKNSDDFDVVIPSRSLREFSAVFTDDIETVEIFFANNQILFRSENISFYTRLLEGNYPDTDRLIPTDFNTTITFNVVNLRQSMERARLLSSATQNGTVKLEIKDGVVSAHVHSPEVGKVNEEIDTDQVTGEDLTISFNPTYLIDSLKALNSEKVTISFISAVRPFTLVPADTDEDFMQLITPVRTN

SEQ ID NO: 5154 - protein, 61 aa, Streptococcus pneumoniae
  misc_feature (B) LOCATION 1...61
  hypothetical: YES
CWFSSTVYEFVKSGRYPRNGWFRRLNAHDEEHITASLDSVGMWDIETNAWVLYLGDKSSER

SEQ ID NO: 5155 - protein, 63 aa, Streptococcus pneumoniae
  misc_feature (B) LOCATION 1...63
  hypothetical: YES
KVKFKIKQDFYDWESNVKRLAGEELEITEERYAELADNIASNGVTISDVLEKILPEPEFLEED

SEQ ID NO: 5156 - protein, 135 aa, Streptococcus pneumoniae
  misc_feature (B) LOCATION 1...135
  hypothetical: YES
CQLSKCHGISGLERNINSKMNDKDRKGACFMDTKELFDALDDFSQQLLVTLADVEAIKKNLKSLVEENTALRLENSKLRERLGEVEADAPVKAKHVRESVRRIYRDGFHVCNDFYGQRREQDEECMFCDELLYRE

SEQ ID NO: 5157 - protein, 294 aa, Streptococcus pneumoniae
  misc_feature (B) LOCATION 1...294
  hypothetical: YES
KELSKGEGLGNKFLANIREVDAIVHVVRAFDDENVMREQGREDAFVDPLADIDTINLELILADLESVNKRYARVEKMARTQKDKESVAEFNVLQKIKPVLEDGKSARTIEFTDEEQKVVKGLFLLTTKPVLYVANVDEDVVSEPDSIDYVKQIREFAATENAEVVVISARAEEEISELDDEDKKEFLEAIGLTESGVDKLTRAAYHLLGLGTYFTAGEKEVRAWTFKRGMKAPQAAGIIHSDFEKGFIRAVTMSYEDLVKYGSEKAVKEAGRLREEGKEYIVQDGDIMEFRFNV

SEQ ID NO: 5158 - protein, 366 aa, Streptococcus pneumoniae
  misc_feature (B) LOCATION 1...366
  hypothetical: YES
QAISEIPGVLRLTLGEPDFTTPDHVKEAAKRAIDQNQSYYTGMSGLLTLRQAASDFVKEKYQLDYAPENEILVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAHVSLGTMLRDQAIIINGLSKSHAMTGWRLGLIFAPAAFTAQLIKSHQYLVTAANTMAQHAAVEALTAGKNDAEPMKKEYIQRRDYIIEKMTALGFEIIKPDGAFYIFAKIPAGYNQDSFAFLKDFAQKKAVAFIPGAAFGRYGEGYVRLSYAASMETIKEAMKRLEEYMREA

SEQ ID NO: 5159 - protein, 271 aa, Streptococcus pneumoniae
  misc_feature (B) LOCATION 1...271
  hypothetical: YES
KDISMQPTYNIDNPNLSYEAKRDLWRIGFGLQKVDNLVPSAYMESLAEKQSRGELTYEQVYEDATAYHHTIDASTEEADLVSLRIVELLSRRGFSFSPATLLAIHKELFQDIFEPSIPVGQFRQTNITKNEPVLNGESVVYSDYSMIQMTLDYDFNQEKQVAYATLTQADVVKQIQHFISGIWQIHPFREGNTRTVTVFLIQYLREFGFDIDNTPFQQHSKYFRDALVLDNAKILQRRSEFLTAFFENLLLGGQNDLSSEKMYLDLDLDFS

SEQ ID NO: 5160 - protein, 125 aa, Streptococcus pneumoniae
  misc_feature (B) LOCATION 1...125
  hypothetical: YES
IRKFAAFKTYVRTSFMLLPRILQVPVELVQYVHEHGKLPVVNFAAGGVATPADAALMMQLGAEGVFVGSGIFKSGDPVKRASAIVKAVTNFRNPQILAQISEDLGEAMVGINENEIQILMAERGK

SEQ ID NO: 5161 - protein, 224 aa, Streptococcus pneumoniae
  misc_feature (B) LOCATION 1...224
  hypothetical: YES
RRKFPMRKKLFLTSAAVLWAVTAMNSVHAATDVQKVIDETYVQPEYVLGSSLSEDQKNQTLKKLGYNASTDTKELKTMTPDVYSKIMNVANDSSLQLYSSAKIQKLGDKSPLEVKIETPENITKVTQDMYRNAAVTLGMEHAKITVAAPIPVTGESALAGIYYSLEANGAKVPQANKDLAQEELKALSDINAENKDKSGYDANKLNVALADIKSGLAKAKESKG

SEQ ID NO: 5162 - protein, 84 aa, Streptococcus pneumoniae
  misc_feature (B) LOCATION 1...84
  hypothetical: YES
REISFYQNHSLIVFLGRLIFTSVASIIIVSSELRGVLEIVTPPLNKSYFNPLAPTDKEDLIRTLELAPHVEGGYFRQTKKLQTL

SEQ ID NO: 5163 - protein, 407 aa, Streptococcus pneumoniae
  misc_feature (B) LOCATION 1...407
  hypothetical: YES
KEISGTIFAVVTLNHYHWSLTVTTLFSLMIMLLVPKIFALKMREVSLNLTNQNEAFLKFSETILNGFDVLASLNFLYVLPKKITEAGILLKLVIQSKTTVVTLAGDISFFLNIFFQISFVFLTGYLAIKGIVKIGTIEAIGALTGVIFTALGELGGQLSFIIGTKPIFLKLYSINPIESNKMNDIEPNEVNRDFPLYEAKNICYKYGDKEILKNLNFCFQRNEKYLILGESGSGKSTLLKLLNGFLRDYSGELRFCGDDIKKTSYLNMVSNVLYVDQKAYLFEGTIRDNILLEENYTDEEILQSLEQVGLSVKDFPNNILDYYVGDDGRLLSGGQKQKITLARGLIRNKKIVLIDEGTSAIDRRTSLAIERKILDREDLTVIIVTHAPHPELKQYFTKIYQFPKDFI

SEQ ID NO: 5164 - protein, 66 aa, Streptococcus pneumoniae
  misc_feature (B) LOCATION 1...66
  hypothetical: YES
LWISVLGMEQWGFLLALVLKHRYCLLRFQERLADMAERSVRLNGLEEQMQVICDDLKNMPAHIQGK

SEQ ID NO: 5165 - protein, 233 aa, Streptococcus pneumoniae
  misc_feature (B) LOCATION 1...233
  hypothetical: YES
GRISMKKYQLLFKISAVFSYLFFVFGLSQLTLIVQNYWQFSSQIGNFVWIQNILSLLFSGVMIWILVKTGHGYLFRIPRKKWLWYSILTVLVVVLHISFNVQTAKHVQSTAEGWNVLIGYSGTNFAELGIYVTLFFLTPLMEELIYRGLLQHAFFKHSRFGLDLLLPSILFALPHFLSLPSLLDIFVFATFGIIFAGLTRYTKSIYPSYAVHVINNIVATFPFLLTFLHRVLG

SEQ ID NO: 5166 - protein, 92 aa, Streptococcus pneumoniae
  misc_feature (B) LOCATION 1...92
  hypothetical: YES
SSVSLCWGSRNICLVSLNSIKSPSRKNPVLSEIREACCMERVTRSMVYLSFRPYKVSSILPAEIGSKAEVGSSKRMILGLVAKTRATQTRCC

SEQ ID NO: 5167 - protein, 196 aa, Streptococcus pneumoniae
  misc_feature (B) LOCATION 1...196
  hypothetical: YES
RAVSSKKRGRRMARTELSDKIETERLVLRVRTVADAEDIHAYASLPEVAYPAGFPPVKTLEDEIYYLEHILPERNQKENLPAGYGIVIKGTDKIAGSVDFNHRYGDDVLELGYTLHSDYWGRGYVPEAARALIDLAFKDLGLHKIELTCFGYNLQSKRVAEKLGFTLEARIRDRKDAQGNCCDDLRYALLKSEWEE

SEQ ID NO: 5168 - protein, 344 aa, Streptococcus pneumoniae
  misc_feature (B) LOCATION 1...344
  hypothetical: YES
DMVSTIGIVSLSSGIIGEDFVKHEVDLGIQRLKVLGLNPIFLPHSLKGLDFIKDHPEARAEDLIHAFSDDSIDMILCAIGGDDTYRLLPYLFENDQLQKAIKQKIFLGFSDTTMNHLMLHKLGIKTFYGQSFLADICELDKEMLAYSLHYFKELIETGRISEIRPSDVWYEERTDFSPTALGTPRVSHTNTGFDLLQGSAQFEGKILGGCLESLYDIFDNSRYADSTELCQKYKLFPDLSDWEGKILLLETSEEEPKPEDFKKMLLTLKDTGIFAVINGLLVGKPMDETFHDDYKEALLDIIDNNIPIVYNLNVGHATPRAIVPFGVHAHVDAQEQVIRFDYNK

SEQ ID NO: 5169 - protein, 530 aa, Streptococcus pneumoniae
  misc_feature (B) LOCATION 1...530
  hypothetical: YES
SSVSVMSWKVSIGRCWMARPSQNPLSFGQGLITSSGCLVKLSSSSYQLGITWSVSRKMGTNQILGIVLGICLVSPQLLNAYAVASTPAADIAANWVWNFGYFTVNRIGYQAQVIPALLAGLSLSYLEIFWRKHIPEVISMIFVPFLSLIPALILAHTVLGPIGWTIGQGLSSVVLAGLTGPVKWLFGAIFGALYAPFVITGLHHMTNAIDTQLIADAGGTALWPMIALSNIAQGSAVFAYYFMHRHDECEAQVSLPATISAYLGVTEPALFGVNVKYIYPFVAGMTGSALAGMLSVTFNVTAASIGIGGLPGILSIQPQYMLPFAGTMLVAIVVPMLLTFFFRKAGLFTKIEGDTNLQAEFVAQEEAEFVSHEPVELTSVEIISPLTGQVKELSQATDPVFASGVMGQGLVIEPSQGELTSPVNGTVTVLFPTKHAIGIVSDEGVELLIHIGMDTVGLDGKGFESLVVQGDHVIVGQQLIRFDMDVIKAAGLVTETPVIITNQDAYTATITGTYPTTIQAGASLMVATRI

SEQ ID NO: 5170 - protein, 120 aa, Streptococcus pneumoniae
  misc_feature (B) LOCATION 1...120
  hypothetical: YES
TRVSTFFVGFDNFLWILACREFRRGICRVLVDEELAAIGVWLTSISHSKSTADVIQIRSNLVLETSSFVFSLILVMPDGLTTCTVPFWISSLDHKAIDDTVEGNTVIVAFFGVSEEIFNR

SEQ ID NO: 5171 - protein, 347 aa, Streptococcus pneumoniae
  misc_feature (B) LOCATION 1...347
  hypothetical: YES
LASSVYSLFVWYNLFLKKEREVISMRKWTKGFLIFGVVTTVIGFILLFVGIQSDGIKSLLSMSKEPVYDSRTEKLTFGKEVENLEITLHQHALTITDSFDDQIHISYHPSLSAHHDLITNQNDRTLSLTDKKLSETPFLSSGIGGILHIASSYSSRFEEVILQLPKGRTLKGINISANRGQTTIINASLENATLNTNSYILRIEGSRIKNSKLTTPNIVNIFDTVLTDSQLESTENHFHAENIQVHGKVELTAKDYLRIILDQKESQRINWDISSNYGSIFQFTREKPESRGTELSNPYKTEKTDVKDQLIARSDDNIDLISTLRDXXXXXXTKGXTSKAXXTRRKK

SEQ ID NO: 5172 - protein, 90 aa, Streptococcus pneumoniae
  misc_feature (B) LOCATION 1...90
  hypothetical: YES
KHSSKTQPSIPCRCSLYWRYGLLSCEDLRLGSVDSSTKQLREISSCSNTEDFQAVRAQIRYRDEADGKVKLPSYLERFWTCSWTYSGCNS

SEQ ID NO: 5173 - protein, 80 aa, Streptococcus pneumoniae
  misc_feature (B) LOCATION 1...80
  hypothetical: YES
RLEFAGFTWSLCLRIYLHEPLITTVSQDFTSLSDISATHFEQLHIMTIVHSDIQRNNSPLTCDNRLSLHSVAFLFTRIIR

SEQ ID NO: 5174 - protein, 93 aa, Streptococcus pneumoniae
  misc_feature (B) LOCATION 1...93
  hypothetical: YES
KSSSALALLFSIIRVKTIPFVILDEVEAALDEANVKRFGDYFNRFDKDSQFIVVTHRKGTMAAADSIYGVTMQESGVSKIVSVKLKDLESIEG

SEQ ID NO: 5175 - protein, 84 aa, Streptococcus pneumoniae
  misc_feature (B) LOCATION 1...84
  hypothetical: YES
AVPSSAIFPWSRKIIRSVMAWANCISWVTKIMVRPSWVKSLISSSTSRTISGSSEAVTSSKRMISGCIRRARTIATRCFCPPDN

SEQ ID NO: 5176 - protein, 336 aa, Streptococcus pneumoniae
  misc_feature (B) LOCATION 1...336
  hypothetical: YES
QMPSHYTRNKTFMDIYIKKAIIHQFSPDDTELFLADKFLNITPKIEEYLRKKIEHVYSDEAKTGIFEEENPFFNHITDDLLETSVTLANLWKEEFSISENLKTNDLIFVQFSKEGVEHFAFLRIALRETLTHLGGEVDNPIKLTQNNLPGFGTGADEALVVNLQSRKYHLIEKRIKYNGTFLNYFSDNLLAVAPKISPKKSIKELEKTAQRIAESFNTDDFQFQSKVKSAIFNNLEESNELSPEKLANDLFDNNLTARLSFIDQVKEAVPEPVQFDEIDASRQLKKFENQKLSLSNGIELIVPNNVYQDAESVEFIQNENGTYSILIKNIEDIQSK

SEQ ID NO: 5177 - protein, 175 aa, Streptococcus pneumoniae
  misc_feature (B) LOCATION 1...175
  hypothetical: YES
QTPSKVFQTNCCQVHSQRLTLQLLMDLVLQMLSCQDLPLVLIGQLITIVLLIVFKNPILIITGFVPVFFDNAAIAVYADKRGGWKAAVILSFISGVLQVALGALCVALLDLASYGGYHGNIDFEFPWLGFGYIFKYLGIVGYVLVCLFLLVIPQLQFAKAKDKEKYYNGEVQEEA

SEQ ID NO: 5178 - protein, 360 aa, Streptococcus pneumoniae
  misc_feature (B) LOCATION 1...360
  hypothetical: YES
GGTSSRTNEDGSLSRSKVKDITQQLAMLHEAGHELILGSSGAIAAGFGALGFKKRPTKIADKQASAAVGQGLLLEEYTTNLLLRQIVSAQILLTQDDFVDKRRYKNAHQALSVLLNRGAIPIINENDSVVIDEVKVGDNDTLSAQVAAMVQADLLVLLTDVDGLYTGNPNSDPRAKRLERIETINREIIDMAGGAGSSNGTGGMLTKIKAATIATESGVPVYICSSLKSDSMIEAAEETEDGSYFVAQEKGLRTQKQWLAFYAQSQGSIWVDKGAAEALSQHGKSLLLSGIVEAEGAFSYGDIVTVFDKESGKSLGKGRVQFGASALEDMLRSQKAKGVLIYRDDWISITPEIQLLFTEF

SEQ ID NO: 5179 - protein, 195 aa, Streptococcus pneumoniae
  misc_feature (B) LOCATION 1...195
  hypothetical: YES
ILTSHSQRGISVVSQSYINVIGAGLAGSEAAYQIAERGIPVKLYEMRGVKSTPQHKTDNFAELVCSNSLRGDALTNAVGLLKEEMRRLGSVILESAEATRVPAGGALAVDRDGFSQMVTEKVVNHPLIEVVRDEITELPTDVITVVATGPLTSDALAEKIHALNNGDGFYFYDAAAPIIDVNTIDMSKVYLNNLR

SEQ ID NO: 5180 - protein, 77 aa, Streptococcus pneumoniae
  misc_feature (B) LOCATION 1...77
  hypothetical: YES
YLTSFSVPKIASSKVKLTRYWRSSPWRGAFGLREEPPPPKKLEKISSKPPKPPAPLKPPKPPAPPKPPLAPAAPYWS

SEQ ID NO: 5181 - protein, 86 aa, Streptococcus pneumoniae
  misc_feature (B) LOCATION 1...86
  hypothetical: YES
LPTSMIFPWSRTMTRLVRSAILRRWATKRMVLSVRDIRLSITFFSVKTSRPLVASSSIKTGALVKRARARAIRCFCPPDRPAPSES

SEQ ID NO: 5182 - protein, 253 aa, Streptococcus pneumoniae
  misc_feature (B) LOCATION 1...253
  hypothetical: YES
IRTSFLERSEFMSQDEKLIREQICDVCHKMWQLGWVAANDGNVSVRLDEDTILATPTGISKSFITPEKLVKLNLKGEILEAEGDYCPSSEIKMHIRCYEEREDVRSVVHAHPPIATGFALAHIPLDTYSLIESAIVVGAIPITPFGVPSTMEVPEAITPYLPDHDVMLLENHGALTVGSDVITAYYRMETLELVAKTTFHGRMLLSTKGIEEQEIARPTLERLFSMRENYKVTGRHPGYRKYNGDGSIKETKK

SEQ ID NO: 5183 - protein, 143 aa, Streptococcus pneumoniae
  misc_feature (B) LOCATION 1...143
  hypothetical: YES
LLTSSVSSTTSKPCFELTSSVLSTTSKLCFEQPAASFLVCSLIFIEFIFYRSALFCFCCVLFVTFDHLFSVPSKDTDIEYKEGYCTKDCFDITSCSVTNCPTKKFFDWSFKSRVSNQLSLAHTFWEGTYTFSKFCCKWCNKCT

SEQ ID NO: 5184 - protein, 435 aa, Streptococcus pneumoniae
  misc_feature (B) LOCATION 1...435
  hypothetical: YES
QVTSPSKFCSNGAIRNPLSLFGAPVTPASYGSSVVPILIMVWLMKYIEKMIAKLTPAVTKSFLQPTLVLLVSSCIALVVVGPIGVIVGEGLSNLVGQMYGVAGWLTLAILGAIMPFIVMTGMHWAFAPIFLAASIATPDVLILPAMLGSNLAQGAASMAVALKSKNNNTKQIAFAAGFSALLAGITEPALYGVTLKYKKPLYAAMIGGGLAGLFAGLTSVKAYLFAVPSLIALPQFIYSDVPSNIVNALIVAVISVVITFVLAYIFGIDEEESSSNLEVKAGVSNKKMIFSPISGEIIPLSDVQDKTFSDKLIGDGVAIIPSEGKVYAPFDGKITNIFPTKHAIGLKSDEGVELLIHIGLDTVELKGQGFISHVEEGDRVFKNQLIFEMDLNLIKTKGYETVTPVIVTNTNDFLDVLVLPNNQTIEHSKELLVIL

SEQ ID NO: 5185 - protein, 394 aa, Streptococcus pneumoniae
  misc_feature (B) LOCATION 1...394
  hypothetical: YES
IGASIFNLVFIVYASTLSQASFAVAMANIVMLLSDLFTVFAGIRADYTRAKVKWMVYSGLFQAVLFFLAALVVQQASLFAFSSLCFINVISDIISDFAGGLRIALIKEKVAEDDLMEAYSFSQFITYISAIGGQAFGVWLLALSVNNFSLVAGINACFFLVSATILFLGKSKLSLSMSSADGEKLKNEKLSIKDQFLTIYRNLRLVFLKSGQKNFGFMLCAVLLVNALGGALGGIYNIFFLSHSLLNFSYTEALFINQVCVLLAIIISSLTGNDYFGKQSLPRLMMWETVGLSLVGLANLFNQVVLGLLFLFFTLYVSGKVQPKISAMLMKNLAPEVLARTSNFLGLLFTLSIPVGTACFSLVAVWNIQLTWMLFVGLSLLAIFLTILNLKNDI

SEQ ID NO: 5186 - protein, 207 aa, Streptococcus pneumoniae
  misc_feature (B) LOCATION 1...207
  hypothetical: YES
AIASLLATGMALFFKASTAAATAVSIPRRIPIGFAPAVTFLIPSRTIAWVKTVAVVVPSPAISLVLEATSDTNLAPIFSKWSSNSISLAMVTPSLVIKGEPNDFSRTTLRPFGPKVTLTVSARISTPRTMAERASDENLISFDILTFSFYSSMIAKMLASPTMMYFSSPSLTSRPAWASTKTRSPVLTLGATKSPFKVRTPCPVATT

SEQ ID NO: 5187 - protein, 491 aa, Streptococcus pneumoniae
  misc_feature (B) LOCATION 1...491
  hypothetical: YES
DLASIRKRRVMMPIQNKTMLITYSDSLGNNLKDLYDNLEEHFRDAIGGVHLLPFFPSTGDRGFAPVDYDEVDSAFGDWEDVKRLGERYYLMFDFMINHISRQSKYYKDYQEKHEASEFKALFLNWDKFWPENRPTQSDVDLIYKRKDRAPKQEIVFEDGSVEHLWNTFGEEQIDLDVTKEVTMEFIRKTIQHLASNGCDLIRLDAFAYAVKKLDTNDFFVEPDIWDLLDKVRDIATEYGTEFLPEIHEHYSIQFKIADHDYYVYDFALPMVTLYTLYSSRTERLAKWLKMSPMKQFTTLDTHDGIGVVDVKDILTDEEIDYASNELYKVGANVKRKYSSAEYNNLDIYQINSTYYSALGDDEVKYFLARLIQAFAPGIPQVYYVGLLAGKNDLKLLEETKEGRNINRHYYSNEEIAKEVQRPVVKALLNLFSFRNRSEAFDLEGTTEIETPTAHSIVIKRQNKDKSVTAVAEIDLQNQTYRVIENGVEVTF

SEQ ID NO: 5188 - protein, 100 aa, Streptococcus pneumoniae
  misc_feature (B) LOCATION 1...100
  hypothetical: YES
TAYSCSAASSVASAFVAFSASSASKAALASWAAFSRAFSRSSTWMTSSSIPSSKSRSSTSWSSSSRTRMSRPRDCNSLTRTRKDSGTPGFGIGLPFVIAS

SEQ ID NO: 5189 - protein, 142 aa, Streptococcus pneumoniae
  misc_feature (B) LOCATION 1...142
  hypothetical: YES
NGELNMLANGITLSYGETKDSYTKLVGLKEVPEFGIELEKVENTTLEDTVKKYEFGIGDIGELEYKFSYNNSSATAPYRVLRKAADDKKKLYFEQAYPDGTKVIFEGQVSVKLGGGGVNAVIDFTLKIALQSNLTFTDGIGG

SEQ ID NO: 5190 - protein, 116 aa, Streptococcus pneumoniae
  misc_feature (B) LOCATION 1...116
  hypothetical: YES
FAYSATSSIKCVTKTMVIPDWWSFLNRVINSFLPRGSRPAVGSSKTNIAGSMASMPAMATRLICPPDSSNGLRSKSDSSIPTRASFSRAVFTASSSETPKFCGPKATSFKTVSSKI

SEQ ID NO: 5191 - protein, 133 aa, Streptococcus pneumoniae
  misc_feature (B) LOCATION 1...133
  hypothetical: YES
KCHSMEPQAIVTSQERIVSLNIAVNYCHDMKLFKMSRRNIGQAGKILADSGYQGPMKIYPQAQTPRKSSNLKPLIAEDKAYNHALSKERSKVENIFAKVKTFKMFSTTYRNHRKRFGLRMNLIVGIINHELGF

SEQ ID NO: 5192 - protein, 212 aa, Streptococcus pneumoniae
  misc_feature (B) LOCATION 1...212
  hypothetical: YES
IMEFRTIKEDGQVQEEIKKSRFICHAKRVYSEEEARDFITAIKKEHYKATHNCSAFIIGERSEIKRTSDDGEPSGTAGVPMLGVLENHNLTNVCVVVTRYFGGIKLGAGGLIRAYAGSVALAVKEIGIIEIKEQAGIAIQMSYAQYQEYSNFLKEHDLMELDTNFTDQVDTMIYVDKEEKETIKAALVEFFNGKVTLTDQGLREVEVPVNLV

SEQ ID NO: 5193 - protein, 120 aa, Streptococcus pneumoniae
  misc_feature (B) LOCATION 1...120
  hypothetical: YES
VMELMNKTRVTDSLAVVIGPESIEVLVTEGFLFDVAIRFVKVDETNLDQGNEKPVFTPEYKLVTVAKYKEKPIFESEEDIRKFEKQAKEVKSLFAFAKVNKQNWFNTALYPGVLTEKVGV

SEQ ID NO: 5194 - protein, 270 aa, Streptococcus pneumoniae
  misc_feature (B) LOCATION 1...270
  hypothetical: YES
QMELTKYASSMLLDPEYGLPATKALDEKAGLLLAYEKTGYDTTSTKRLPDCLDVWSAKRIKEEGADAVKFLLYYDVDSSDELNQEKQAYIERIGSECVAEDIPFFLEILAYDEKIADAGSVEYAKVKPHKVIGAMKVFSDPRFNIDVLKVEVPVNIKYVEGFAEGEVVYTREEAAAFFKAQDEATNLPYIYLSAGVSAKLFQDTLVFAHESGANFNGVLCGRATWAGSVEAYIKDGEAAAREWLRTTGFENIDELNKVLQTTATSWKERV

SEQ ID NO: 5195 - protein, 67 aa, Streptococcus pneumoniae
  misc_feature (B) LOCATION 1...67
  hypothetical: YES
TCHSCNKGSTLKGKPVAQTTYEAVSKALVTAEDTIISADESKGFLLNFWTCCRPISDKGAKSIPNPI

SEQ ID NO: 5196 - protein, 75 aa, Streptococcus pneumoniae
  misc_feature (B) LOCATION 1...75
  hypothetical: YES
GGHSFIKHKTGWFDGMMTTGCSMGAYHALNFFLQHPDVFTKVIALSGVYDARFFVGDYYNDDAIYQNSPVDYIWN

SEQ ID NO: 5197 - protein, 378 aa, Streptococcus pneumoniae
  misc_feature (B) LOCATION 1...378
  hypothetical: YES
MKHSVHFGAGNIGRGFIGEILFKNGFHIDFVDVNNQIIYALNEKGKYEIEIAQKGQSRIEVTNVAGINSKEHPEQVIEAIQKTDIITTAIGPNILPFIAELLAKGIEARRVAGNTQALDVMACENMIGGSQFLYQEVKKYLSPEGLTFADNYIGFPNAAVDRIVPTQSHEDSLFVMVEPFNEWVVETKRLKNPDLRLKDVHYEEDLEPFIERKLFSVNSGHATSAYIGAHYGAKTILEALQNPNIKSRIESVLAEIRSLLIAKWNFDKKELENYHKVIIERFENPFIVDEVSRVARTPIRKLGYNERFIRPIRELKELSLSYKNLLKTVGYAFDYRDVNDEESIRLGELLAKQSVKDVVIQVTGLDDQELIEQIVEYI

SEQ ID NO: 5198 - protein, 291 aa, Streptococcus pneumoniae
  misc_feature (B) LOCATION 1...291
  hypothetical: YES
KEELKMEKLVAYKRMPLWNKQTMPEAVQQKHNTKVGTWGKITVLKGALKFIELTEEGEVLAEHLFEAGADNPMAQPQAWHRVEAATDDVEWYLEFYCKPEDYFAKKYNTNPVHSEVLEAMQTVKQGKALDLGCGQGRNSLFLAQQDFDVTAVDQNGLALEILQSIVEQEDLDMPVDLYDINSASIEQEYDFIVSTVVLMFLQADRIPAIIQNMQEKTSVGGYNLIVCAMDTEDYPCSVNFPFTFKEGELADYYKDWELVKYNENPGHLHRRDENGNRIQLRFATLLAKKIK

SEQ ID NO: 5199 - protein, 161 aa, Streptococcus pneumoniae
  misc_feature (B) LOCATION 1...161
  hypothetical: YES
GGNSRQDPYHGPGQAQGLSFSVPDSIPAPPSLQNILKELSDDIGVKKSHDLTAWAEQGVLLLNACLTVPAGQANGHAGQIWEPFTDAVIQVVNHLDRPVVFVLWGAYARKKKALVTNPHHLIIESAHPSPLSVYRGFWGSKPFSKANAFLKETGQEPIALA

SEQ ID NO: 5200 - protein, 99 aa, Streptococcus pneumoniae
  misc_feature (B) LOCATION 1...99
  hypothetical: YES
HFNSFFNLIQGMSNNIQAQKGNDKSQSVDKGNSLNTYNIDKECASQIGDNTDNPHQRLPEPHGIMQVVLNYTDVEGVHHVGRQVAQGVRDEVDDDNHND

SEQ ID NO: 5201 - protein, 440 aa, Streptococcus pneumoniae
  misc_feature (B) LOCATION 1...440
  hypothetical: YES
KDNSMIHLIMISAIALAIGIGYRTKINIGLLAIAFSYLIATTLMGLSPKELLHFWPTSLFFTIFSVSLFYNVATTNGTLDVLAQHILYRTRTHPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 5202 - protein, 424 aa, Streptococcus pneumoniae
  misc_feature (B) LOCATION 1...424
  hypothetical: YES
IINSHSMCRHKEKSMKLFWTNNIYRQLLLNSCFSSFGDSIFYLAIINYVAQYNFAPLAILLISISEMVPLLSQLFLGILGDFQENRVKHALWIAKIKILLYAILTVFLVLSPFSLVSVIMIVIINLISDTLSYLSAYMMNALYISVIKDDLHDAMGFRQSLMRVVRIVANLAGAFLINVISIQTISLINTLTFVIAFLGLYVIRHTLYEVEKRIEMSHTALSFKKYFQHLKQSLAVLLRLKDTVILLFLTTSMIAILDVSPRLIALRFIQQTLAQLSIGQLLALLSIIMSCGAILGNMTSSNLFKNIRFTHLLVFCEISLLTLITSILCQAYIVIFMTSFISSTIIGILSPRLQAAVFAHIPSDKMGTVGSALSTVDILAPSLLSLLALSIASGVSVQLALIFLYLILIALIFCQWLVKFNTHN

SEQ ID NO: 5203 - protein, 205 aa, Streptococcus pneumoniae
  misc_feature (B) LOCATION 1...205
  hypothetical: YES
VMNSFKNFLKEWGLFLLILSLLALSRIFFWSNVRVEGHSMDPTLADGEILFVVKHLPIDRFDIVVAHEEDGNKDIVKRVIGMPGDTIRYENDKLYINDKETDEPYLADYIKRFKDDKLQSTYSGKGFEGNKGTFFRSIAQKAQAFTVDVNYNTNFSFTVPEGEYLLLGDDRLVSSDSRHVGTFKAKDITGEAKFRFWPITRIGTF

SEQ ID NO: 5204 - protein, 138 aa, Streptococcus pneumoniae
  misc_feature (B) LOCATION 1...138
  hypothetical: YES
VSNSLEEKEMKVNIADLHPTQLYLSEKKLQDIQMLYQSAETIQVDPISILAFGDCLLITDGHHRAYQALLAGRDTISAEWDRDGGDELYHLYAQACEERKIYSVFDLEDRILAQDGYEAKWYNWCDGFNQAATLLLKR

SEQ ID NO: 5205 - protein, 361 aa, Streptococcus pneumoniae
  misc_feature (B) LOCATION 1...361
  hypothetical: YES
ENDSLAVLEIGILNSEYVIISISRRCFRLEKKLTIKDIAEMAQTSKTTVSFYLNGKYEKMSQETREKIEKVIHETNYKPSIVARSLNSKRTKLIGVLIGDITNSFSNQIVKGIEDIASQNGYQVMIGNSNYSQESEDRYIESMLLLGVDGFIIQPTSNFRKYSRIIDEKKKKMVFFDSQLYEHRTSWVKTNNYDAVYDMTQSCIEKGYEHFLLITADTSRLSTRIERASGFVDALTDANMRHASLTIEDKHTNLEQIKEFLQKEIDPDEKTLVFIPNCWALPLVFTVIKELNYNLPQVGLIGFDNTEWTCFSSPSVSTLVQPSFEEGQQATKILIDQIEGRNQEERQQVLDCSVNWKESTF

SEQ ID NO: 5206 - protein, 352 aa, Streptococcus pneumoniae
  misc_feature (B) LOCATION 1...352
  hypothetical: YES
ATDSPLKKRKKQMTNKNAYAQSGVDVEAGYEVVERIKKHVARTERAGVMGALGGFGGMFDLSKTGVKEPVLISGTDGVGTKLMLAIKYDKHDTIGQDCVAMCVNDIIAAGAEPLYFLDYVATGKNEPAKLEQVVAGVAEGCVQAGAALIGGETAEMPGMYGEDDYDLAGFAVGVAEKSQIIDGSKVVEGDVLLGLASSGIHSNGYSLVRRVFADYTGEEVLPELEGKKLKEVLLEPTRIYVKAVLPLIKEELVNGIAHITGGGFIENVPRMFADDLAAEIDESKVPVLPIFKALEKYGQIKHEEMFEIFNMGVGLMLAVSPENVERVKELLDEAVYEIGRIVKKENESVIIK
